United States Patent 7,745,391 (HUMAN THROMBOSPONDIN POLYPEPTIDE) - sequence listing, part 167

SEQ ID NO: 425606 - DNA, 5148 bp, Homo sapiens
gttgcattctatgttgccagtgttcctgctgccagaattggatccaacccattgttccagacaagatcagggcaactagtatggaaaacataacctcaagtatctttgatgtaatctccaagggaaaagttgctccaactttttcttactgggtcttttcggaatgatggtttgaaagcttctgatgtccttcctatcctaaaggaaaaggtggccttcgtgtctggtgaggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcacgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagctttgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagtccctctttcatgccacttccttgcagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagaggatggagtggaggatattgacagaaagaggccagaactggagagagacagaaccagtctacgttgcagctctgtcccccttagtagctatttgagtgtgaggaagttactgaacttctgtttcccacatgagaaatggtgataatagattcagccttgcagagtagtcgagtgggttttctaagcgtatgttgtcatttctcatgggtgcagagcactcagcactagctgcccgtggt

SEQ ID NO: 425607 - DNA, 2392 bp, Homo sapiens
tctgaggatcccgtttgataggtaacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaaggatggcaaccttgttcctcggtggcacctgggacctggagatcctttctccacttacgtttagcgcgcatcctgggacttgtccctgcagctcaccgggttagccgtggcaccgttgggacctcccaccaggactccaatcacccacctctcttgagacttctctggcagggctggtgtggggtgcagcctttgctcagagggcaacatgttccaagcaaaatctccccgcctgggccatgggctcaccctcggggctcccttcttctctactgggtgcaattcgaggttgctgagcttctctccaaagtctaaaatggtggggcagtagggacctgtgagaggcccaatggcccaatgtacttcccccagatcccactcagaacagcaggtacgcccaggctcctgctgccctagaggtctgcaacatgagtgaagaggttaattagagggacacacttatctctgaagtttttctccaggctgaacatttctattatcagtggcccctaatctggaaaaacccatcattctaatctagcttgtatccccacatcatgagaaagagggaagaagaagaagggatgatgtgtggtagagaagatgagggttaactttagcctttcccaaacactggcaacaaccacttcctcaacaatttttctatttgcttcagcctactcagattttttcaggtttttctagctcctccataacctcactccctcccgaggtctctggttcaaagaccaccctaccagcccctatttgcttcaggttatcctgttgagggtgggtgggaagagtgagaagatataaatgaaaaactggccacatgttgataattgttgaaactagatgatggtacgtggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattctaaagcaggctgttga

SEQ ID NO: 425608 - DNA, 5116 bp, Homo sapiens
gttgcattctatgttgccagtgttcctgctgccagaattggatccaacccattgttccagacaagatcagggcaactagtatggaaaacataacctcaagtatctttgatgtaatctccaagggaaaagttgctccaactttttcttactgggtcttttcggaatgatggtttgaaagcttctgatgtccttcctatcctaaaggaaaaggtggccttcgtgtctggtgaggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcacgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagctttgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagtccctctttcatgccacttccttgcagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgccctaagtttccccactgccctccccttccccgcctctcataggcatttcctgtctacagacctcagagctgggtgtgaccgagcacgtggagggcgatccctgcaaattcgccttgtggtctgggcgcaccccatcctcagacaataaaacagtgctgaaaggatggagtggaggatattgacagccagggggatgggagcagccaaccagacaccatctccattgcttctaggacctctcagaacacagtggacagtgacaaggactagctgctgtgtgcggatcctccttaaggtatgccatgtttagcatatgtgtccagtgctggctcagaaaatctccatgcccttttttatggactgcccttattcaggcaggtgacttagtaacctgagtgtaggactactttatgtctattagattttctcttatttagttccatctcagtg

SEQ ID NO: 425609 - DNA, 2440 bp, Homo sapiens
gttgcattctatgttgccagtgttcctgctgccagaattggatccaacccattgttccagacaagatcagggcaactagtatggaaaacataacctcaagtatctttgatgtaatctccaagggaaaagttgctccaactttttcttactgggtcttttcggaatgatggtttgaaagcttctgatgtccttcctatcctaaaggaaaaggtggccttcgtgtctggtgaggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcacgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagctttgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggaggccaggtcagcatgggcagagctttccagtgggaaatgcctcgggctagacgtgagataagtcctgtcccagtcttgactcagcaaaatcttgctttgtggtcttgtgtgagcttcggtttctttatctgtaagatgtaaaaatgcctgcaccatactcaacttgaatctagaataaaatagtaaatgg

SEQ ID NO: 425610 - DNA, 2536 bp, Homo sapiens
gttgcattctatgttgccagtgttcctgctgccagaattggatccaacccattgttccagacaagatcagggcaactagtatggaaaacataacctcaagtatctttgatgtaatctccaagggaaaagttgctccaactttttcttactgggtcttttcggaatgatggtttgaaagcttctgatgtccttcctatcctaaaggaaaaggtggccttcgtgtctggtgaggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcacgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagctttgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggaggccaggtcagcatgggcagagctttccagtgggaaatgcctcgggctagacgtgagataagtcctgtcccagtcttgactcagcaaaatcttgctttgtggtcttgtgtgagcttcggtttctttatctgtaagatgtaaaaatgcctgcaccatactcaacttgaatctagaataaaatagtaaatggaaaagctttaatgtttcaaagaattatttatcattcaggatgttattcagccatcagtaagtaacataaatacaacaaaaattaacaaaagacaaa

SEQ ID NO: 425611 - DNA, 544 bp, Homo sapiens
cggccgcagcagctgcgccccgcgccctccgcccaccgggcgccgagcagccctcggccccaggcttcttcggctcccggctgcccgcggacgccctcccacagtcatgaacccccctgagggagcagcggaggaaggaggagcagcagactcggacgtggacgcctttttccggacgggtcttttcggaatgatggtttgaaagcttctgatgtccttcctatcctaaaggaaaaggtggccttcgtgtctggtgaaggccaggtcagcatgggcagagctttccagtgggaaatgcctcgggctagacgtgagataagtcctgtcccagtcttgactcagcaaaatcttgctttgtggtcttgtgtgagcttcggtttctttatctgtaagatgtaaaaatgcctgcaccatactcaacttgaatctagaataaaatagtaaatggaaaagctttaatgtttcaaagaattatttatcattcaggatgttattcagccatcagtaagtaacataaatacaacaaaaattaacaaaagacaaa

SEQ ID NO: 425612 - DNA, 320 bp, Homo sapiens
ctgttctttttctccatttttgctcaatttctatttgtttcacacacttgcttctttccctaatccttctccctttttactctctctcctattttctctatatgcatcttggtctcttttgtttctctttttactcccctctccctatgaaagaacatgttctcatacttgtctacctttttctctttcttcctctcttctgacccctgcctttctcctctcagagttcacacacatgcacacacccctctgtgtctaattgcacattgttctcatccctgcaggagatacaacagcggcatggtctggccaactccatc

SEQ ID NO: 425613 - DNA, 211 bp, Homo sapiens
tgaattcttagagataaccccttttaccccacctcactttctttatagctcagagggaaccattacagagagcgaagctggtctataatttccttgctgggttaggtggtgggaggaagctgggggagatggccctaattatgtccggacttttttttccccaggaacttttaacttgctgtgaagaagggaaaggggagctcaaggatgg

SEQ ID NO: 425614 - DNA, 399 bp, Homo sapiens
gacacaaaagcagttcttctggggtggtaaatggctggcagttgtagaggcttgctaaagcagtcagcagtctgtagaaactgctgatcctgactgatctgtgactcctgaccagtgagtcccatggcctccactcaccatttccgaggcaggctgtggtcattattatgtggatttatcttgtcctttccctcatcctatttctgccctgttcttcccctgacatcactgagtatccttgtctgtgtctgccccttccagacgagcatggtatctgtggagggcctcacaaagctggtggacccctcccagctgacggaggagtttgatggctccctggactacaaccatgaggagtggatcgaactgcggctctccctggaggagttcttcaacagc

SEQ ID NO: 425615 - DNA, 4722 bp, Homo sapiens
ggggaggagagacaagcaggggcggcagaggctcaacgggatgctgactgggttttgcttttcgtcccagccttgtggggccgggacggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagtctccgctggttcatcctccaagccatggatgccgctcgactcacaacagcccaattcacactgctactggctcacgacttactcagaacttctctgtgtctgttcccactctcatctatactggtacgagactgctcagactccagagctggggagatgcaggccacgggcagagtggctgcagaggcaggcaggcaggaatgggaagtggtagtgctggaaaagaaggggggccctttaaagctcttttaagacaacagactcaatcagcgttggaacagaggggaggatcgcctcataggttctgtagaaggcgggaatttccattttttaccttgacggcatttcctcctggattccttgtacacgttgggggtgtagttagtgcacgttctgtgaagcttttggatcgtatccacaatcctgcctttgtcggaattatgggtaacacaagatcttacaaactgctagactggaatagtttcaattcagatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagcaacgtcagttgattacagttcctttgcagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgacgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtataaaaataaactggaatattcctaaatctcttttttacctccatcat

SEQ ID NO: 425616 - DNA, 732 bp, Homo sapiens
acaaaacattaacaaaaatggccctttggttttcctcttactgattgtagaaagaagatactttaataacagataagtcaactactaacttttaaaaatatattcttcaacatttgattctctttttttaaaattttagggtaaaactagggaaatgaattattcacaaagctttgattataaaataaaatagaaacaactgaaatattgtaaattaagaagaataggaaataaagttagttaaagcacagtatgtggtcctttcattgatatttatgttagaccccactcaggctctccctaggagaccacacaactatgacatcaccagaaatgctcagcctgctaactgagaacttggttttggacaaatcagtgtctaaagcttgactctttactatctctcttatctgacttgaaaaggaccattctttttctgagttacagttaaattacatcatcgaaaggagtgttaagacgagtaagagacatcatccatatttttttctttgtttttttcttttgttttctgtctgtgttttcagcaacgtcagttgattacagttcctttgcagacagatgcagcagctggatagagctcattaaactgaaagctcagaccataaggcgtggatcaattaagacaagtaggcggatgtttctaccacattatgataatctgagaaacatatccctgatttcccagtggtgaaagctagaccttactaccca

SEQ ID NO: 425617 - DNA, 4422 bp, Homo sapiens
ggggaggagagacaagcaggggcggcagaggctcaacgggatgctgactgggttttgcttttcgtcccagccttgtggggccgggacggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagattcccttcaatgaagatcccaatcccaatactcactcatcaggaccctcaacccctctgaaaaaccaaacttattccttttcaccttccaagtcctacagtcgacagtcctcttcttctgacacagatttgagtttgacacccaaaactggaatgggaagtggtagtgctggaaaagaaggggggccctttaaagctcttttaagacaacagactcaatcagcgttggaacagagggaatttccattttttaccttgacggcatttcctcctggattccttgtacacgttgggggtgtagttagtgcacgttctgtgaagcttttggatcgtatccacaatcctgatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgacgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtataaaaataaactggaatattcctaaatctcttttttacctccatcat

SEQ ID NO: 425618 - DNA, 4356 bp, Homo sapiens
ggggaggagagacaagcaggggcggcagaggctcaacgggatgctgactgggttttgcttttcgtcccagccttgtggggccgggacggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagattcccttcaatgaagatcccaatcccaatactcactcatcaggaccctcaacccctctgaaaaaccaaacttattccttttcaccttccaagtcctacagtcgacagtcctcttcttctgacacagatttgagtttgacacccaaaactggaatgggaagtggtagtgctggaaaagaaggggggccctttaaagctcttttaagacaacagactcaatcagcgttggaacagagggaatttccattttttaccttgacggcatttcctcctggattccttgtacacgttgggggtgtagttagtgcacgttctgtgaagcttttggatcgtatccacaatcctgatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagccatgacagttgaaaaagcaagtccagtgggtgatggaaatttccggaatcgttctgctccaccttgtgcaaattccacagttggggttgttaagatgacacctctttcttttattcctggagcagaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgacgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtataaaaataaactggaatattcctaaatctcttttttacctccatcat

SEQ ID NO: 425619 - DNA, 4359 bp, Homo sapiens
ggggaggagagacaagcaggggcggcagaggctcaacgggatgctgactgggttttgcttttcgtcccagccttgtggggccgggacggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagattcccttcaatgaagatcccaatcccaatactcactcatcaggaccctcaacccctctgaaaaaccaaacttattccttttcaccttccaagtcctacagtcgacagtcctcttcttctgacacagatttgagtttgacacccaaaactggaatgggaagtggtagtgctggaaaagaaggggggccctttaaagctcttttaagacaacagactcaatcagcgttggaacagagggaatttccattttttaccttgacggcatttcctcctggattccttgtacacgttgggggtgtagttagtgcacgttctgtgaagcttttggatcgtatccacaatcctgatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacgtaagtggtgacgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtataaaaataaactggaatattcctaaatctcttttttacctccatcat

SEQ ID NO: 425620 - DNA, 2415 bp, Homo sapiens
cctagaagtgccattttaatagctatgagaccttgggcaagttacttaacttctctaaccttccatttcctcatgcatgaaatggggatgatgatgataacctgtgtttttgggtggttgtaaggattagatatatatatatatgtctggcttatggcagttatttaataagtggtagctattatttttttactttataaacaaccaacttttagctagcagaggtcgttaagcttttaaaattatgagttggttttcaaaaaggtttggaaaaaaccagtatcttacaactagataacataaggtttatctacaagttgacaatgatgaagtcgtctgaaaaagatggaaaaattgcactgggaaatagaacaactttcacactctccttgtaataatttgttcctacagcagataattttaatgctcagccgctttttctttttcttcactttataaccaatcattgtgtgtgtagctatactgcatcaacattttcttttgcaggaatgccatttttcttccaaaagaattccattccagcatttcctctcatgtttttctgtctctcttttttaattgcatgcagtgcatgataatttcttttctttcatgacatggcttagcctcacagacagctgaatgttgtcaccacttatttggaaacctcagggaataattgtgttaccagcgtctgttctgaatgttttctcatttttctccaattttagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgacgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtataaaaataaactggaatattcctaaatctcttttttacctccatcat

SEQ ID NO: 425621 - DNA, 2210 bp, Homo sapiens
gtgttatagttagaacttcatataataattgaaaaatgtcatttaacacaaaaatcaatgaaatattatcatatattttgattacaatttattttgacaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgacgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtataaaaataaactggaatattcctaaatctcttttttacctccatcat

SEQ ID NO: 425622 - DNA, 2156 bp, Homo sapiens
gtgttatagttagaacttcatataataattgaaaaatgtcatttaacacaaaaatcaatgaaatattatcatatattttgattacaatttattttgacaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgtggaactgtgttcagattcacttccttctcatccttttccaccagctaaagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgacgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtataaaaataaactggaatattcctaaatctcttttttacctccatcat

SEQ ID NO: 425623 - DNA, 2331 bp, Homo sapiens
acaaaacattaacaaaaatggccctttggttttcctcttactgattgtagaaagaagatactttaataacagataagtcaactactaacttttaaaaatatattcttcaacatttgattctctttttttaaaattttagggtaaaactagggaaatgaattattcacaaagctttgattataaaataaaatagaaacaactgaaatattgtaaattaagaagaataggaaataaagttagttaaagcacagtatgtggtcctttcattgatatttatgttagaccccactcaggctctccctaggagaccacacaactatgacatcaccagaaatgctcagcctgctaactgagaacttggttttggacaaatcagtgtctaaagcttgactctttactatctctcttatctgacttgaaaaggaccattctttttctgagttacagttaaattacatcatcgaaaggagtgttaagacgagtaagagacatcatccatatttttttctttgtttttttcttttgttttctgtctgtgttttcagcaacgtcagttgattacagttcctttgcagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgacgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtataaaaataaactggaatattcctaaatctcttttttacctccatcat

SEQ ID NO: 425624 - DNA, 1568 bp, Homo sapiens
caccagatcctagtatctcgggactcttgtcctgtttattgattcctgagactacttctcttctgaaggaacgccgaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgacgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtataaaaataaactggaatattcctaaatctcttttttacctccatcat

SEQ ID NO: 425625 - DNA, 4377 bp, Homo sapiens
ggggaggagagacaagcaggggcggcagaggctcaacgggatgctgactgggttttgcttttcgtcccagccttgtggggccgggacggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagattcccttcaatgaagatcccaatcccaatactcactcatcaggaccctcaacccctctgaaaaaccaaacttattccttttcaccttccaagtcctacagtcgacagtcctcttcttctgacacagatttgagtttgacacccaaaactggaatgggaagtggtagtgctggaaaagaaggggggccctttaaagctcttttaagacaacagactcaatcagcgttggaacagagggaatttccattttttaccttgacggcatttcctcctggattccttgtacacgttgggggtgtagttagtgcacgttctgtgaagcttttggatcgtatccacaatcctgatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgacgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtata

SEQ ID NO: 425626 - DNA, 933 bp, Homo sapiens
ggggaggagagacaagcaggggcggcagaggctcaacgggatgctgactgggttttgcttttcgtcccagccttgtggggccgggacggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtaagtttttaaatgtcagcatttttgagtgtatttttttgaggtgactcttttccctcaggaataatgagaaccttttatttcaggcatagtagtatttctacatcacaaaaatattttcttttctgcttacctaggaatattgagtctaaaaaaagttgtattacatttaagaaaatacagtatatgataacacattaacaaaagaagtcttcagatgtattatattattattattgtagttttctctagattttagcacataccaaaaattacttaagaataatatatggattaaaataaatttttaaaaattgtagtactatatattgtgaatattgccatttaaatcatttgtaagtgtacagtttggtagcattaattacattcacagtgttttgctaccatcaccgctatttccagaactttttctttatcctaaatggaaattgtgtactcactaaccaataacttcccattccctcctctccctagactctggtgacctctaatctactttctgtctctttgaatttgcttatgctagatat

SEQ ID NO: 425627 - DNA, 806 bp, Homo sapiens
gtcactgttataattattttgatatttagcatttcccaaagttatacggtctgaaaaatgttaacttgtttgtgttttttcctttatagtgaagaggtctgcattttatctgcatctggcacagcggctgtactgaatcctagatttctgcaggatggcaccgtggaaggctgtttggaacagaggttgtcatggcagcctggcttattttctataagggcagagaagggagaggtcgactttttttctgagagttgggataattcttctccgtagggtggcttacaggggtacagtgtagaaatcaggaccaagcacttcactaatttttaactaacccgtagtaacagaggagtattggattctgcactatatggcacacattattgtttctagtgtcttgataagtgacatgtatgattaccagttgaagaatttcaggtgtccatttttttttgctttgtcatgatatagaaataatctttggatctttctcttcctttcatttccctgtgtctcacctccaaaaacagaaagaggttatgaaacaatttttataaaaaacaattcttaatttacaaaatagtaaaagtactgcattttatcaagattatctgtagatataatatatatggtccttccgtgtccatagggaattggttccaggaccccttgcagataccaaaacctgcagatgctcaagtcccttatataaaatggtatagtatttgcatgtaacctatgcacattctcccctatactttaaataatctctagattatttataatacctgatataatacctg

SEQ ID NO: 425628 - DNA, 300 bp, Homo sapiens
tccgcgccccgagagccgccatttttgagagcgggggaggagagacaagcaggggcggcagaggctcaacgggatgctgactgggttttgcttttcgtcccagccttgtggggccgggacggaagaacccatcaaagcccttcctcccgccgcctctccggaatgaggtctcagcacccgcgcgggacagcacccttcctcctgcgacagtgagtggcgacccgtggcgcgactgccgggcgcccgcgcgcgcccccgcgcgctccttcgctgtcagttaccccgcgcgcctccgcccct

SEQ ID NO: 425629 - DNA, 2354 bp, Homo sapiens
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaagaaaaaaaaaaa

SEQ ID NO: 425630 - DNA, 5199 bp, Homo sapiens
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatgggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtttctctttgtactttttattttttatttgtatttattgatgtgaaattcacatataaaattaaccattgtaaagtgaataattcagtggcacttaacagcttcattgacacatccacatatacagttcaatccagtagtttttagtgtattcacagagttgtgcgaccatctgcacagtcaattccagaacattttcagcacccccccacgagaaaccccatacccagtagcaatcactccccacttccccttctgcaagctcctggcaaccactaaagctgctttcggtctctctggatttgcctaccctgggtatttcatataaatgggaacatagtatgtggccctttgtgattggctccattcactaagcatagtcttttaaggttcatccacattgtagcatatgtcagtgctttattccttatttttttaaccaaataaaattcaggtgctatctgttaggaaagtcttatcgttaaaggttggtaatttctgagaaccaagtttagatttatgttctgcagtttttaacagtcttgaggcagtctttaattcagttgctgtgtgaataatttcatctttttctttggaagagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaagaaaaaaaaaaa

SEQ ID NO: 425631 - DNA, 2337 bp, Homo sapiens
acgcgcggttgggagcctcgcccatgctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaagaaaaaaaaaaa

SEQ ID NO: 425632 - DNA, 5143 bp, Homo sapiens
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatgggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtttctctttgtactttttattttttatttgtatttattgatgtgaaattcacatataaaattaaccattgtaaagtgaataattcagtggcacttaacagcttcattgacacatccacatatacagttcaatccagtagtttttagtgtattcacagagttgtgcgaccatctgcacagtcaattccagaacattttcagcacccccccacgagaaaccccatacccagtagcaatcactccccacttccccttctgcaagctcctggcaaccactaaagctgctttcggtctctctggatttgcctaccctgggtatttcatataaatgggaacatagtatgtggccctttgtgattggctccattcactaagcatagtcttttaaggttcatccacattgtagcatatgtcagtgctttattccttatttttttaaccaaataaaattcaggtgctatctgttaggaaagtcttatcgttaaaggttggtaatttctgagaaccaagtttagatttatgttctgcagtttttaacagtcttgaggcagtctttaattcagttgctgtgtgaataatttcatctttttctttggaagagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaagaaaaaaaaaaa

SEQ ID NO: 425633 - DNA, 4147 bp, Homo sapiens
gcggccgcccgcgaactagttctagatcgcgagcggccgcccgcgatctacaactagcaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatgggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtttctctttgtactttttattttttatttgtatttattgatgtgaaattcacatataaaattaaccattgtaaagtgaataattcagtggcacttaacagcttcattgacacatccacatatacagttcaatccagtagtttttagtgtattcacagagttgtgcgaccatctgcacagtcaattccagaacattttcagcacccccccacgagaaaccccatacccagtagcaatcactccccacttccccttctgcaagctcctggcaaccactaaagctgctttcggtctctctggatttgcctaccctgggtatttcatataaatgggaacatagtatgtggccctttgtgattggctccattcactaagcatagtcttttaaggttcatccacattgtagcatatgtcagtgctttattccttatttttttaaccaaataaaattcaggtgctatctgttaggaaagtcttatcgttaaaggttggtaatttctgagaaccaagtttagatttatgttctgcagtttttaacagtcttgaggcagtctttaattcagttgctgtgtgaataatttcatctttttctttggaagagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaagaaaaaaaaaaa

SEQ ID NO: 425634 - DNA, 4654 bp, Homo sapiens
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatgggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtttctctttgtactttttattttttatttgtatttattgatgtgaaattcacatataaaattaaccattgtaaagtgaataattcagtggcacttaacagcttcattgacacatccacatatacagttcaatccagtagtttttagtgtattcacagagttgtgcgaccatctgcacagtcaattccagaacattttcagcacccccccacgagaaaccccatacccagtagcaatcactccccacttccccttctgcaagctcctggcaaccactaaagctgctttcggtctctctggatttgcctaccctgggtatttcatataaatgggaacatagtatgtggccctttgtgattggctccattcactaagcatagtcttttaaggttcatccacattgtagcatatgtcagtgctttattccttatttttttaaccaaataaaattcaggtgctatctgttaggaaagtcttatcgttaaaggttggtaatttctgagaaccaagtttagatttatgttctgcagtttttaacagtcttgaggcagtctttaattcagttgctgtgtgaataatttcatctttttctttggaagagacacctgtgcatagcagatcatcttcacctattcctctgactcctagcaaggaagggagtgctgtgtttgctggctttgaagggagaagaactaatgaaataaacgaggtaaagaatgtttgatgtttgttcccaatggttccttcatttgtgattacttcaattctataggtggaagtcaaggttcttaaagcatcatgttgctgctattactgtaaacattatcaaaattgtacgtaattttatgcttaacactgtgggttttggtttctaaagtgagaaaattgttaggattccagccctacactgacaatcatcttttaaataagtgcaattattgaaataccagtatttttactttatagaacagatgtcaatttccacagagggccagagggtaaatactttcggctttgtgggccatatggtgtctgtcaaggctacttaactccaaaagtagccacagatagtatgtaaataaaatgagtgtgctatattccaataaaacttgatttatggacactgaaaaaa

SEQ ID NO: 425635 - DNA, 2018 bp, Homo sapiens
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatggcaaaaaaaaaacaaaaaaacaaaacaaaaaacaaactgttttggggcgcgcgccttcggcgccctctggagaacagcgttttctgaacacccattctggtggcggcgcgcgcggggcccccacgagatgagtgtatcggttgaaacagtgtggccaaaagggtgttcccccagggagaacaccccggggccagataggaaaacaggggcgtgggggaattctcttccacaatatttaaaacaagccccgggggggaacaccagggaggcgtcttcggaacaaaatctctccagaagtggggattctcggggagggctcataaacgcgggagcttattatccaacaggggacgttcccagaggagaagcctccgaaattctcaaaatattacccccggcttctgggtggctc

SEQ ID NO: 425636 - DNA, 1112 bp, Homo sapiens
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaagtcaatctttttttcctaagaaaaaatgtccgcgagtattaaatatttagatcaatgtttataaaatgattactttgtatatctcattattcctattttggaataaaaactgaccttctttaatcatatacttgtcttttgtaaatagcagcttttgtgtcattctccctactttattagttaatttaaattggaaaaaaccctcaaactaatattcttgtctgttccagtcttataaataaaacttataatgcatgt

SEQ ID NO: 425637 - DNA, 470 bp, Homo sapiens
atcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaa

SEQ ID NO: 425638 - DNA, 540 bp, Homo sapiens
gtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacattt

SEQ ID NO: 425639 - DNA, 2318 bp, Homo sapiens
aggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaagaaaaaaaaaaa

SEQ ID NO: 425640 - DNA, 2237 bp, Homo sapiens
tgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaagaaaaaaaaaaa

SEQ ID NO: 425641 - DNA, 2057 bp, Homo sapiens
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacgggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaagaaaaaaaaaaa

SEQ ID NO: 425642 - DNA, 3525 bp, Homo sapiens
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatgggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtt

SEQ ID NO: 425643 - DNA, 1754 bp, Homo sapiens
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtaaagaatgtttgatgtttgttcccaatggttccttcatttgtgattacttcaattctataggtggaagtcaaggttcttaaagcatcatgttgctgctattactgtaaacattatcaaaattgtacgtaattttatgcttaacactgtgggttttggtttctaaagtgagaaaattgttaggattccagccctacactgacaatcatcttttaaataagtgcaattattgaaataccagtatttttactttatagaacagatgtcaatttccacagagggccagagggtaaatactttcggctttgtgggccatatggtgtctgtcaaggctacttaactccaaaagtagccacagatagtatgtaaataaaatgagtgtgctatattccaataaaacttgatttatggacactgaaaaaa

SEQ ID NO: 425644 - DNA, 2530 bp, Homo sapiens
  misc_feature (33)..(33): n is a, c, g, or t
ccggcccttccgcctcactcagcggcgccactnagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgaggtgtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaaaaaaaaaa

SEQ ID NO: 425645 - DNA, 2699 bp, Homo sapiens
  misc_feature (33)..(33): n is a, c, g, or t
ccggcccttccgcctcactcagcggcgccactnagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgaggtgtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaaaaaaaaaa

SEQ ID NO: 425646 - DNA, 2426 bp, Homo sapiens
  misc_feature (33)..(33): n is a, c, g, or t
ccggcccttccgcctcactcagcggcgccactnagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgaggtgtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaaaaaaaaaa

SEQ ID NO: 425647 - DNA, 2603 bp, Homo sapiens
  misc_feature (33)..(33): n is a, c, g, or t
ccggcccttccgcctcactcagcggcgccactnagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgaggtgtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggttcccagtgacagcagaatgagcttggcttggcagtagctgcagagggacccatggctgttcaggttcgcggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaaaaaaaaaa

SEQ ID NO: 425648 - DNA, 2482 bp, Homo sapiens
  misc_feature (33)..(33): n is a, c, g, or t
ccggcccttccgcctcactcagcggcgccactnagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgaggtgtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaaaaaaaaaa

SEQ ID NO: 425649 - DNA, 2195 bp, Homo sapiens
  misc_feature (33)..(33): n is a, c, g, or t
ccggcccttccgcctcactcagcggcgccactnagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgaggtgtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccaca

SEQ ID NO: 425650 - DNA, 2215 bp, Homo sapiens
  misc_feature (33)..(33): n is a, c, g, or t
ccggcccttccgcctcactcagcggcgccactnagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgaggtgtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgggagaagactgcgcctcttcatgtataaaatccctgttctttctctgccaccctggcgtagattat

SEQ ID NO: 425651 - DNA, 1030 bp, Homo sapiens
  misc_feature (33)..(33): n is a, c, g, or t
ccggcccttccgcctcactcagcggcgccactnagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgaggtgggtccttcatccagataggggagtgcggggagggaaatccaagaggtcaaaggttagcagtcggactggggttttgaaaattgcaggttgggtaataagagactgggagtcaggtggggcgtggtggctcatgcctgtaatcccaacactttgggaggccgaggcaggtggatcactggaggtcaggagttagagaccatcctggccaatatggcgaaaccctgtctctactaaaaatacaacaacaacaaaaaaaggtagctgggtgtggtggcgcatgcctgtagtcccagctactcgggaggctgaggttgcagtgagtcaagatcaggccattgcactgcagccttggtgacacagtaagactctatctcaaaaaaa

SEQ ID NO: 425652 - DNA, 1418 bp, Homo sapiens
  misc_feature (33)..(33): n is a, c, g, or t
ccggcccttccgcctcactcagcggcgccactnagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgaggtgtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggaggtctgacccctgacccttgacccctgaccccagctccacttg

SEQ ID NO: 425653 - DNA, 694 bp, Homo sapiens
  misc_feature (33)..(33): n is a, c, g, or t
ccggcccttccgcctcactcagcggcgccactnagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcagggtagagatcaagaagacagcggtacaagatctgagcttcaacaagaacctgaggtggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagag

SEQ ID NO: 425654 - DNA, 334 bp, Homo sapiens
cgcccatcctggctgccctgcatgcccagaaccagctcaccgaggagcagaggtgaccaccctgtagcctgtcccagccccaccccagctgagcctgggtcaccaactggattccacccactccatacacacctccagctcctcccaagaccccctcttgagccctgatcccccactacaacctgtgaccttgcagtatctccagtcgaatcaaatagactgggcctggtggtttactcgtgtaatcccagcacttgggaggccaaggtgggtggatcacttgagcccaggatttcgagaccagcctgggcaacatggcgaaaccccatatcta

SEQ ID NO: 425655 - DNA, 3440 bp, Homo sapiens
cgaactctgaaaaggcggggcagcgggcctgcagctcctggagttcagggagacccggaaatctcaccctgccctcttcttgtgttgtgtttgtcacagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgaccgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagaga

SEQ ID NO: 425656 - DNA, 515 bp, Homo sapiens
gataggtgatggctggtgggttcagagtaattaagactgatggataactgcagagaggaaatctagttttcagggcaaacagatgcgtccaagagagagcccacacacgtggttggatgcagctggagatggagaattccagttcaaggaaaaggcctgggcatgtagaagcacgaggctgatgactcatttaccattggaagacttcaaatccaaactgcagttgtcaaaataagattagtgctttcagacatgatgaaagagagggcatggtctcgaaaaggcaagcttgggttttgcctgcatttgtggagccctaactcatagcaagctttcctgtgggagtgggcagagaccccatcgtttacccagttgagtgaaatggcagccctaataacccacttctccttctctcttgctgtgataaacaatttctgatttctacatctcagattaaataacagcaagagctataaaaagtagagggtgtctcctaaaggtgttcatttgcttta

SEQ ID NO: 425657 - DNA, 435 bp, Homo sapiens
gaaaggaggagactaggcacagctggagtttgcctgaaaggataattttctcagtgacattgggtttgttttgtttctttcagtgtagaagcacgaggctgatgactcatttaccattggaagacttcaaatccaaactgcagttgtcaaaataagattagtgctttcagacatgatgaaagagagggcatggtctcgaaaaggcaagcttgggttttgcctgcatttgtggagccctaactcatagcaagctttcctgtgggagtgggcagagaccccatcgtttacccagttgagtgaaatggcagccctaataacccacttctccttctctcttgctgtgataaacaatttctgatttctacatctcagattaaataacagcaagagctataaaaagtagagggtgtctcctaaaggtgttcatttgcttta

SEQ ID NO: 425658 - DNA, 534 bp, Homo sapiens
gataggtgatggctggtgggttcagagtaattaagactgatggataactgcagagaggaaatctagttttcagggcaaacagatgcgtccaagagagagcccacacacgtggttggatgcagctggagatggagaattccagttcaaggaaaaggcctgggcagtatgtgtttggtggtggtcgttgaccctgaaaatagatggaatcttggagggagaaagcgagtgtggaaagtgaaggtcaggttgtgagctctggggcagcccacagtcagagggtgggtcaaagctagaagggcgagcaggccgcacgcacacacacgcaaagcagctgccttcactgacaatcaatggcagccacctgagctgtggctgagctgctgtgagccgaagcagtgggcttgctaaatgccgtcatccagcttccccttgaccctggctgtcaggcctgggtctgggagcttagggatcattttgtgcagtctgctcaccctctggctgtgccagggcacaggattttctacaaaagaagga

SEQ ID NO: 425659 - DNA, 2859 bp, Homo sapiens
cacgcgtcgcccacgcgtcggactagttctagatcgcgagcggccctcgcgcaggcagccagcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagaga

SEQ ID NO: 425660 - DNA, 2777 bp, Homo sapiens
gataggtgatggctggtgggttcagagtaattaagactgatggataactgcagagaggaaatctagttttcagggcaaacagatgcgtccaagagagagcccacacacgtggttggatgcagctggagatggagaattccagttcaaggaaaaggcctgggcagtatgtgtttggtggtggtcgttgaccctgaaaatagatggaatcttggagggagaaagcgagtgtggaaagtgaagtccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagaga

SEQ ID NO: 425661 - DNA, 4219 bp, Homo sapiens
cacgcgtcgcccacgcgtcggactagttctagatcgcgagcggccctcgcgcaggcagccagcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgaccgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaatggtattcagtgcaaaaattcttagtttaactttaaatggaagatatgtatgtatgagaaatggccaacatgcctatgaaaaaaatgctgaatctcatcagtaatcaggaaaatgcaggttaaaacaataccatttttcacccatcagcttagcaaaaatgagtatattttttaacaagtgttggtaaggatgtggaaatgtgaggttcttgtagtaagaatgcaaatggcactctttgtagagtaagtctgttgacatctcataaaactgaaaatgcacacaaccctgtaaatctagcaactgcactcagttgatttcagcccatacatacaaagagacctgcataagaatgttactaggctttgtaaaagcaaaaaataaggaacaacttaaacatcatcagaaggggaactgataaactctggtgtaatccataccacagaaatacaacaccgcatgtacaggaatgtgctacatctatacaaataaatggtcaaactcaaaacaaagatgactttaaaaagaatgacaaaatgtttagcataccattcct

SEQ ID NO: 425662 - DNA, 1794 bp, Homo sapiens
cacgcgtcgcccacgcgtcggactagttctagatcgcgagcggccctcgcgcaggcagccagcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgaccgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggacaatgtgcacaaccggaacatggcttggagcatctgtgttttgacacgggggatccctttgtcgcaattgttaggtttcttaataacgagggccttaagaaccggttcccggtggtttactgtgctgtcgaggtaccatggtgggaccctctggtgttggctcttcct

SEQ ID NO: 425663 - DNA, 441 bp, Homo sapiens
tgtggacaaccatcacttcttttggtcatctttttctgctcagctctagaagactccgatggaagacaggactctccagcaggggaactgccaaaaacggtccaacagccaacaggtacagtttttaaggcagtgtttttagaaattttggtggagggaaccatggtttccctccagataaaagctgtaaagaagtgaatgtaagtatgttcaaattatgataatgaaggccttttttccctcaaaaagatagttaacatttactcttacattaagccatatttggtaactagcatcgtttcaggtgacagtgtttttttgtttttgtttttgttgttgttgtttttttgagacagtttcattctgttgcccaggctggagtgcagtggtacgatttcagctcactgcaacctccacctcctgggctcaagtgattctcct

SEQ ID NO: 425664 - DNA, 3497 bp, Homo sapiens
cgaactctgaaaaggcggggcagcgggcctgcagctcctggagttcagggagacccggaaatctcaccctgccctcttcttgtgttgtgtttgtcacagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgaccgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagaga

SEQ ID NO: 425665 - DNA, 3607 bp, Homo sapiens
cacgcgtcgcccacgcgtcggactagttctagatcgcgagcggccctcgcgcaggcagccagcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgaccgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagaga

SEQ ID NO: 425666 - DNA, 2481 bp, Homo sapiens
agggactggaggagagagttcttgtggtggtggggacagaggctgtaggaagggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagaga

SEQ ID NO: 425667 - DNA, 3076 bp, Homo sapiens
cacgcgtcgcccacgcgtcggactagttctagatcgcgagcggccctcgcgcaggcagccagcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgaccgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacatttagaatttaaaaaaactggcttggaaaaaaatcactaaaaatttaagtgacacaaatcgtgattaactagtccatccagttggagtgaggtccgc

SEQ ID NO: 425668 - DNA, 542 bp, Homo sapiens
cctgcggaactgtgactcaattaaacctctattcttataaattacccaatctcaggtattttgttacagcaatgtgagaactgcctaacacacccatcctccaggaatagaagagaggctggagactgataaacaatcatgcctacgtgatgaagcctttataaaaataagtgaaactgcagggttcaaagagctcctaggttggtgaacacatccacgtgctgtgagggtggctcacttcaactccacagggacagaagcttctacactcagatcctgccagatctcaccctatgtatctcttcatctggctgtttatcccatattcttcattataaccttttcaatataataaattgataagcataagtgattccctgagttctgtgaacctctctagcaaattaatcaaatgcaaggagggggtcatgggaacctccgatttgtagtcaagtggaacagaagttgggggtaacctattgtgattggcatctgaagctggggggcagtcttgtgggattgagcccctactctgtgatatc

SEQ ID NO: 425669 - DNA, 3531 bp, Homo sapiens
tctctgataaccagatttttcccccataatctgtatctgtattcaagtctctatcctcatccccaaatggatttcaccccgcttgtccatcagtctctgcccatttcttctgtctcccacagacatggtctgtgtagttgttctgcacactacccgtcctcgccccttctcatttccctcactccacggacagctacaggagggcttccatcatttgtcctcttacttccttgttagaactttgtgctgctgaccaccactctgaaccaaaacttctttcttggttcttgaaagttgctgtctttctcctccagagggtctgtgtcttccttccaactcttaaacatttttgtttcccagaatccatcattggccattgctttttcacttgccatgagctctgtgaatgagatggttcctgctgaagacatttactttcaatgatctacagaatttcccaaatctatgtctccagactggatgtttctcacgtctgtggcccactgggcatcttctgcactttctctgcatttgtaaacactgagcctgtatgcgtgtctatgtggccatggccctggccgtggggatgcacccataattataatgagagcaggtgaatgtcatgtggctatgtatgagacattgttgtgaatgttttacatgcatcagctctttcaacatttacagcatctgtgtgtggtaggtaatgttgtttccttcattttgcagagcagaatatagataggctcaggttaagaatttgcccaaggttacacagttatgaagtttggatttaggaatgggaggccacgtagactggcttcagaattcatgtctttaaccactttattgcttctcatgttggggggtttgttttctggtcactatttttactaaagttgattcaacaatgctataatctgttactctcattcgacaatacatcttgactgtttcttcaacttgaggaaggtaaaccaaagccactctttaatgggtgcaaatatctgttgtaactatgtagaagatacagtgtctgggtttgaggacaggggagtgggaaaactgagtagggaagcggtaagacatgcatctggctttaggagtgtttgaagtgcctaaagatcagggtgaatttcccaaatttgaatcttgttgcccaagccacattgcaaccacctctttttctcttacctcgtccccacatccaggcactgccccattctgttcattccacctttttttttagtagaccctccatatatgtgtgtgttttggtgaatggccacacacagcaaagttatttttattgcaattttgttgttgttgtttgagacacagagtctcatactctgccacccagactgaagtgcagtggtgcgatctcagttcactgcaacctccatccccccatgttcaagcaattctcctgcctcagcctcccaagtagctgggattacaggcatgggccaccatgcccggctaatttttgtattttttgtagacacggggtttcaccatgttggccaggctggtctcacactcctgacctcaggtgatccacccgcctcggcctcccgaagtgctggcattacaggcatgagccaccacacccagcctttattgcaatttttggttccctcacagaatgtttaccatgaagctgtgcgtataggtggtaccatgtatgacataccttgacctcaaagataatctacctgggctttttttgtttgtttgttttgagatggagtctcactctgtcacccatgctggtgtgcagtggcgtgatcttggctcacagcagcctctgcctcccgggttcaagcgattctcctgcctcagcctcctgagtagctgggactacaggtgcctgcgaccacacccagctaatttttgtatttttagtagtagtgggatttcaccatgttggccaggatggcctccacctcctgacttcatgatccacccgcctcggcctcccaaagtgctgggattacaggcgtgagccaccgcacctggcctacctgggcttttttggacagatgtacatgattttagaaattgttatgaatgactgtcttgggatcctcaagaacacccccaggtttgacgatttgctgagaagactcaggtctcagcattctgtcatactcaacagctatgatttactgcagcaaaaaaatacaaagcaaatagtaaagggaaaaagccaaaattcagagaaaaccaggcacaatcttctgagtcttgtttcagtgaagtcacaggatgtgccttatttaagttccatctggtacttatgacaacacatgctatatgtccactgggaagcttattagagactcagtgccagggtttttattgggcatgttttctagcacatcccacaattctggacttccagaaggttagcaggggttcagcttttcagctgaaaacgttatccccctttcagctggggggaaaaaaaggcaccgaaaaacagggcactgagctactcctgttttgggtgggtggagcagtagtaagcctcccaaaatctaaggtcccacactccagcaagggtgaaccttgcaaactcaaaaggatagcagtctccaacctgctgttttatacagtgacttaagtggtactaaaatgctatataagtcaaatttacgtaacattaagcaaataattttttttcagcaaaaaaataatggtcatgactttgtggtgaaggcttatgtaatgattgtaataaattcaggtggctcacgcctgtgataccagcacttttgggaggctgaggcgggtggatcacttgaggtcaggagtttgagaccagcctggccaacatggtgaaatcccatctctacaaaaatgaaaaattagccgggcgtagtggtacatgcatttagtcctagctacttgggaggctgaggcaggaaaatcgcttgagcctgggaggcagaggttgcagtgagccgagatcatgccactgcactccagcctgggtgacagagtgagactgtgtctcaaaaaaaaaaaaaaaaaaaatgcctcagttttgttaagaggaaaaagcaaatcctaagttacagtggaacttatgaacaccctagcctagagatttaatttagtgatgaaaaggtacagagagagtctttcaagaaaggacctagtctgctcgcgttctctctctctctctctatatatatatatgtatatgtgtgtgtacatatggaccacttcaagctacacacacacacacacacacatatacacgtgtatgaatatatatatatggctataagtggtgcgacttgcaggtactccctttgttcacctttgtaaagatgttattgccagttcagtgtgtatttctatagtatatatgtaaacaatttgtcatccttttgttgctgcttttgaaactagttcatggcttcagtgggggagagatttaaataatatgggtttataatttctgcattattaaatgcagataacttgtgattaaagagtatgttattggaaaaaaaattg

SEQ ID NO: 425670 - DNA, 2266 bp, Homo sapiens
tctctgataaccagatttttcccccataatctgtatctgtattcaagtctctatcctcatccccaaatggatttcaccccgcttgtccatcagtctctgcccatttcttctgtctcccacagacatggtctgtgtagttgttctgcacactacccgtcctcgccccttctcatttccctcactccacggacagctacaggagggcttccatcatttgtcctcttacttccttgttagaactttgtgctgctgaccaccactctgaaccaaaacttctttcttggttcttgaaagttgctgtctttctcctccagagggtctgtgtcttccttccaactcttaaacatttttgtttcccagaatccatcattggccattgctttttcacttgccatgagctctgtgaatgagatggttcctgctgaagacatttactttcaatgatctacagaatttcccaaatctatgtctccagactggatgtttctcacgtctgtggcccactgggcatcttctgcactttctctgcatttgtaaacactgagcctgtatgcgtgtctatgtggccatggccctggccgtggggatgcacccataattataatgagagcaggtgaatgtcatgtggctatgtatgagacattgttgtgaatgttttacatgcatcagctctttcaacatttacagcatctgtgtgtggtaggtaatgttgtttccttcattttgcagagcagaatatagataggctcaggttaagaatttgcccaaggttacacagttatgaagtttggatttaggaatgggaggccacgtagactggcttcagaattcatgtctttaaccactttattgcttctcatgttggggggtttgttttctggtcactatttttactaaagttgattcaacaatgctataatctgttactctcattcgacaatacatcttgactgtttcttcaacttgaggaaggtaaaccaaagccactctttaatgggtgcaaatatctgttgtaactatgtagaagatacagtgtctgggtttgaggacaggggagtgggaaaactgagtagggaagcggtaagacatgcatctggctttaggagtgtttgaagtgcctaaagatcagggtgaatttcccaaatttgaatcttgttgcccaagccacattgcaaccacctctttttctcttacctcgtccccacatccaggcactgccccattctgttcattccacctttttttttagtagaccctccatatatgtgtgtgttttggtgaatggccacacacagcaaagttatttttattgcaattttgttgttgttgtttgagacacagagtctcatactctgccacccagactgaagtgcagtggtgcgatctcagttcactgcaacctccatccccccatgttcaagcaattctcctgcctcagcctcccaagtagctgggattacaggcatgggccaccatgcccggctaatttttgtattttttgtagacacggggtttcaccatgttggccaggctggtctcacactcctgacctcaggtgatccacccgcctcggcctcccgaagtgctggcattacaggcatgagccaccacacccagcctttattgcaatttttggttccctcacagaatgtttaccatgaagctgtgcgtataggtggtaccatgtatgacataccttgacctcaaagataatctacctgggctttttttgtttgtttgttttgagactgtgtctcaaaaaaaaaaaaaaaaaaaatgcctcagttttgttaagaggaaaaagcaaatcctaagttacagtggaacttatgaacaccctagcctagagatttaatttagtgatgaaaaggtacagagagagtctttcaagaaaggacctagtctgctcgcgttctctctctctctctctatatatatatatgtatatgtgtgtgtacatatggaccacttcaagctacacacacacacacacacacatatacacgtgtatgaatatatatatatggctataagtggtgcgacttgcaggtactccctttgttcacctttgtaaagatgttattgccagttcagtgtgtatttctatagtatatatgtaaacaatttgtcatccttttgttgctgcttttgaaactagttcatggcttcagtgggggagagatttaaataatatgggtttataatttctgcattattaaatgcagataacttgtgattaaagagtatgttattggaaaaaaaattg

SEQ ID NO: 425671 - DNA, 3104 bp, Homo sapiens
tctctgataaccagatttttcccccataatctgtatctgtattcaagtctctatcctcatccccaaatggatttcaccccgcttgtccatcagtctctgcccatttcttctgtctcccacagacatggtctgtgtagttgttctgcacactacccgtcctcgccccttctcatttccctcactccacggacagctacaggagggcttccatcatttgtcctcttacttccttgttagaactttgtgctgctgaccaccactctgaaccaaaacttctttcttggttcttgaaagttgctgtctttctcctccagagggtctgtgtcttccttccaactcttaaacatttttgtttcccagaatccatcattggccattgctttttcacttgccatgagctctgtgaatgagatggttcctgctgaagacatttactttcaatgatctacagaatttcccaaatctatgtctccagactggatgtttctcacgtctgtggcccactgggcatcttctgcactttctctgcatttgtaaacactgagcctgtatgcgtgtctatgtggccatggccctggccgtggggatgcacccataattataatgagagcaggtgaatgtcatgtggctatgtatgagacattgttgtgaatgttttacatgcatcagctctttcaacatttacagcatctgtgtgtggtaggtaatgttgtttccttcattttgcagagcagaatatagataggctcaggttaagaatttgcccaaggttacacagttatgaagtttggatttaggaatgggaggccacgtagactggcttcagaattcatgtctttaaccactttattgcttctcatgttggggggtttgttttctggtcactatttttactaaagttgattcaacaatgctataatctgttactctcattcgacaatacatcttgactgtttcttcaacttgaggaaggtaaaccaaagccactctttaatgggtgcaaatatctgttgtaactatgtagaagatacagtgtctgggtttgaggacaggggagtgggaaaactgagtagggaagcggtaagacatgcatctggctttaggagtgtttgaagtgcctaaagatcagggtgaatttcccaaatttgaatcttgttgcccaagccacattgcaaccacctctttttctcttacctcgtccccacatccaggcactgccccattctgttcattccacctttttttttagtagaccctccatatatgtgtgtgttttggtgaatggccacacacagcaaagttatttttattgcaattttgttgttgttgtttgagacacagagtctcatactctgccacccagactgaagtgcagtggtgcgatctcagttcactgcaacctccatccccccatgttcaagcaattctcctgcctcagcctcccaagtagctgggattacaggcatgggccaccatgcccggctaatttttgtattttttgtagacacggggtttcaccatgttggccaggctggtctcacactcctgacctcaggtgatccacccgcctcggcctcccgaagtgctggcattacaggcatgagccaccacacccagcctttattgcaatttttggttccctcacagaatgtttaccatgaagctgtgcgtataggtggtaccatgtatgacataccttgacctcaaagataatctacctgggctttttttgtttgtttgttttgagatggagtctcactctgtcacccatgctggtgtgcagtggcgtgatcttggctcacagcagcctctgcctcccgggttcaagcgattctcctgcctcagcctcctgagtagctgggactacaggtgcctgcgaccacacccagctaatttttgtatttttagtagtagtgggatttcaccatgttggccaggatggcctccacctcctgacttcatgatccacccgcctcggcctcccaaagtgctgggattacaggcgtgagccaccgcacctggcctacctgggcttttttggacagatgtacatgattttagaaattgttatgaatgactgtcttgggatcctcaagaacacccccaggtttgacgatttgctgagaagactcaggtctcagcattctgtcatactcaacagctatgatttactgcagcaaaaaaatacaaagcaaatagtaaagggaaaaagccaaaattcagagaaaaccaggcacaatcttctgagtcttgtttcagtgaagtcacaggatgtgccttatttaagttccatctggtacttatgacaacacatgctatatgtccactgggaagcttattagagactcagtgccagggtttttattgggcatgttttctagcacatcccacaattctggacttccagaaggttagcaggggttcagcttttcagctgaaaacgttatccccctttcagctggggggaaaaaaaggcaccgaaaaacagggcactgagctactcctgttttgggtgggtggagcagtagtaagcctcccaaaatcgagatcatgccactgcactccagcctgggtgacagagtgagactgtgtctcaaaaaaaaaaaaaaaaaaaatgcctcagttttgttaagaggaaaaagcaaatcctaagttacagtggaacttatgaacaccctagcctagagatttaatttagtgatgaaaaggtacagagagagtctttcaagaaaggacctagtctgctcgcgttctctctctctctctctatatatatatatgtatatgtgtgtgtacatatggaccacttcaagctacacacacacacacacacacatatacacgtgtatgaatatatatatatggctataagtggtgcgacttgcaggtactccctttgttcacctttgtaaagatgttattgccagttcagtgtgtatttctatagtatatatgtaaacaatttgtcatccttttgttgctgcttttgaaactagttcatggcttcagtgggggagagatttaaataatatgggtttataatttctgcattattaaatgcagataacttgtgattaaagagtatgttattggaaaaaaaattg

SEQ ID NO: 425672 - DNA, 3464 bp, Homo sapiens
tctctgataaccagatttttcccccataatctgtatctgtattcaagtctctatcctcatccccaaatggatttcaccccgcttgtccatcagtctctgcccatttcttctgtctcccacagacatggtctgtgtagttgttctgcacactacccgtcctcgccccttctcatttccctcactccacggacagctacaggagggcttccatcatttgtcctcttacttccttgttagaactttgtgctgctgaccaccactctgaaccaaaacttctttcttggttcttgaaagttgctgtctttctcctccagagggtctgtgtcttccttccaactcttaaacatttttgtttcccagaatccatcattggccattgctttttcacttgccatgagctctgtgaatgagatggttcctgctgaagacatttactttcaatgatctacagaatttcccaaatctatgtctccagactggatgtttctcacgtctgtggcccactgggcatcttctgcactttctctgcatttgtaaacactgagcctgtatgcgtgtctatgtggccatggccctggccgtggggatgcacccataattataatgagagcaggtgaatgtcatgtggctatgtatgagacattgttgtgaatgttttacatgcatcagctctttcaacatttacagcatctgtgtgtggtaggtaatgttgtttccttcattttgcagagcagaatatagataggctcaggttaagaatttgcccaaggttacacagttatgaagtttggatttaggaatgggaggccacgtagactggcttcagaattcatgtctttaaccactttattgcttctcatgttggggggtttgttttctggtcactatttttactaaagttgattcaacaatgctataatctgttactctcattcgacaatacatcttgactgtttcttcaacttgaggaaggtaaaccaaagccactctttaatgggtgcaaatatctgttgtaactatgtagaagatacagtgtctgggtttgaggacaggggagtgggaaaactgagtagggaagcggtaagacatgcatctggctttaggagtgtttgaagtgcctaaagatcagggtgaatttcccaaatttgaatcttgttgcccaagccacattgcaaccacctctttttctcttacctcgtccccacatccaggcactgccccattctgttcattccacctttttttttagtagaccctccatatatgtgtgtgttttggtgaatggccacacacagcaaagttatttttattgcaattttgttgttgttgtttgagacacagagtctcatactctgccacccagactgaagtgcagtggtgcgatctcagttcactgcaacctccatccccccatgttcaagcaattctcctgcctcagcctcccaagtagctgggattacaggcatgggccaccatgcccggctaatttttgtattttttgtagacacggggtttcaccatgttggccaggctggtctcacactcctgacctcaggtgatccacccgcctcggcctcccgaagtgctggcattacaggcatgagccaccacacccagcctttattgcaatttttggttccctcacagaatgtttaccatgaagctgtgcgtataggtggtaccatgtatgacataccttgacctcaaagataatctacctgggctttttttgtttgtttgttttgagatggagtctcactctgtcacccatgctggtgtgcagtggcgtgatcttggctcacagcagcctctgcctcccgggttcaagcgattctcctgcctcagcctcctgagtagctgggactacaggtgcctgcgaccacacccagctaatttttgtatttttagtagtagtgggatttcaccatgttggccaggatggcctccacctcctgacttcatgatccacccgcctcggcctcccaaagtgctgggattacaggcgtgagccaccgcacctggcctacctgggcttttttggacagatgtacatgattttagaaattgttatgaatgactgtcttgggatcctcaagaacacccccaggtttgacgatttgctgagaagactcaggtctcagcattctgtcatactcaacagctatgatttactgcagcaaaaaaatacaaagcaaatagtaaagggaaaaagccaaaattcagagaaaaccaggcacaatcttctgagtcttgtttcagtgaagtcacaggatgtgccttatttaagttccatctggtacttatgacaacacatgctatatgtccactgggaagcttattagagactcagtgccagggtttttattgggcatgttttctagcacatcccacaattctggacttccagaaggttagcaggggttcagcttttcagctgaaaacgttatccccctttcagctggggggaaaaaaaggcaccgaaaaacagggcactgagctactcctgttttgggtgggtggagcagtagtaagcctcccaaaatctaaggtcccacactccagcaagggtgaaccttgcaaactcaaaaggatagcagtctccaacctgctgttttatacagtgacttaagtggtactaaaatgctatataagtcaaatttacgtaacattaagcaaataattttttttcagcaaaaaaataatggtcatgactttgtggtgaaggcttatgtaatgattgtaataaattcaggtggctcacgcctgtgataccagcacttttgggaggctgaggcgggtggatcacttgaggtcaggagtttgagaccagcctggccaacatggtgaaatcccatctctacaaaaatgaaaaattagccgggcgtagtggtacatgcatttagtcctagctacttgggaggctgaggcaggaaaatcgcttgagcctgggaggcagaggttgcagtgagccgagatcatgccactgcactccagcctgggtgacagagtgagactgtgtctcaaaaaaaaaaaaaaaaaaaatgcctcagttttgttaagaggaaaaagcaaatcctaagttacagtggaacttatgaacaccctagcctagagatttaatttagtgatgaaaaggtacagagagagtctttcaagaaaggacctagtctgctcgcgttctctctctctctctacatatacacgtgtatgaatatatatatatggctataagtggtgcgacttgcaggtactccctttgttcacctttgtaaagatgttattgccagttcagtgtgtatttctatagtatatatgtaaacaatttgtcatccttttgttgctgcttttgaaactagttcatggcttcagtgggggagagatttaaataatatgggtttataatttctgcattattaaatgcagataacttgtgattaaagagtatgttattggaaaaaaaattg

SEQ ID NO: 425673 - DNA, 2818 bp, Homo sapiens
tctctgataaccagatttttcccccataatctgtatctgtattcaagtctctatcctcatccccaaatggatttcaccccgcttgtccatcagtctctgcccatttcttctgtctcccacagacatggtctgtgtagttgttctgcacactacccgtcctcgccccttctcatttccctcactccacggacagctacaggagggcttccatcatttgtcctcttacttccttgttagaactttgtgctgctgaccaccactctgaaccaaaacttctttcttggttcttgaaagttgctgtctttctcctccagagggtctgtgtcttccttccaactcttaaacatttttgtttcccagaatccatcattggccattgctttttcacttgccatgagctctgtgaatgagatggttcctgctgaagacatttactttcaatgatctacagaatttcccaaatctatgtctccagactggatgtttctcacgtctgtggcccactgggcatcttctgcactttctctgcatttgtaaacactgagcctgtatgcgtgtctatgtggccatggccctggccgtggggatgcacccataattataatgagagcaggtgaatgtcatgtggctatgtatgagacattgttgtgaatgttttacatgcatcagctctttcaacatttacagcatctgtgtgtggtaggtaatgttgtttccttcattttgcagagcagaatatagataggctcaggttaagaatttgcccaaggttacacagttatgaagtttggatttaggaatgggaggccacgtagactggcttcagaattcatgtctttaaccactttattgcttctcatgttggggggtttgttttctggtcactatttttactaaagttgattcaacaatgctataatctgttactctcattcgacaatacatcttgactgtttcttcaacttgaggaaggtaaaccaaagccactctttaatgggtgcaaatatctgttgtaactatgtagaagatacagtgtctgggtttgaggacaggggagtgggaaaactgagtagggaagcggtaagacatgcatctggctttaggagtgtttgaagtgcctaaagatcagggtgaatttcccaaatttgaatcttgttgcccaagccacattgcaaccacctctttttctcttacctcgtccccacatccaggcactgccccattctgttcattccacctttttttttagtagaccctccatatatgtgtgtgttttggtgaatggccacacacagcaaagttatttttattgcaattttgttgttgttgtttgagacacagagtctcatactctgccacccagactgaagtgcagtggtgcgatctcagttcactgcaacctccatccccccatgttcaagcaattctcctgcctcagcctcccaagtagctgggattacaggcatgggccaccatgcccggctaatttttgtattttttgtagacacggggtttcaccatgttggccaggctggtctcacactcctgacctcaggtgatccacccgcctcggcctcccgaagtgctggcattacaggcatgagccaccacacccagcctttattgcaatttttggttccctcacagaatgtttaccatgaagctgtgcgtataggtggtaccatgtatgacataccttgacctcaaagataatctacctgggctttttttgtttgtttgttttgagatggagtctcactctgtcacccatgctggtgtgcagtggcgtgatcttggctcacagcagcctctgcctcccgggttcaagcgattctcctgcctcagcctcctgagtagctgggactacaggtgcctgcgaccacacccagctaatttttgtatttttagtagtagtgggatttcaccatgttggccaggatggcctccacctcctgacttcatgatccacccgcctcggcctcccaaagtgctgggattacaggcgtgagccaccgcacctggcctacctgggcttttttggacagatgtacatgattttagaaattgttatgaatgactgtcttgggatcctcaagaacacccccaggtttgacgatttgctgagaagactcaggtctcagcattctgtcatactcaacagctatgatttactgcagcaaaaaaatacaaaaattagcgcagtggcaggcgcctgtgaggcaggagaattgcttgaatgcgaatggcagaggttgcagtgagtgaaaatcacactactgcactccagcctgggagcataaagtgagactgtctcaaataaataaataaataaataaataaataaaacctgaggttgagcacgatggctcacacctatagtcccagcactttgggaggctgaggtgggtggatcatttgaggccaggagttgaagaccagtctggccaacatggcaaaacccatctctacgaaagaagaaacacaaaaaaaaaacaaaaaacttttggcccccctgggccctgaaaaccttttgtctgaaacactacttcattagtgacaccggaggccccagtgacgcttacgtgcgacactgggtgcaaacagagcgtgcacacacgaagcaaaaacctgcccggggccagagcaacatacagcgcgcggaatattccaccgccattataaaaaacaccgccggggcgggacaccggacgcttttcacaaaacaacctctcagactgagagccgtgagaagcgaccaaaagagggacctcatcaccaccgagggagtcacacacgagccctcagaattaaatttacg

SEQ ID NO: 425674 - DNA, 2266 bp, Homo sapiens
tctctgataaccagatttttcccccataatctgtatctgtattcaagtctctatcctcatccccaaatggatttcaccccgcttgtccatcagtctctgcccatttcttctgtctcccacagacatggtctgtgtagttgttctgcacactacccgtcctcgccccttctcatttccctcactccacggacagctacaggagggcttccatcatttgtcctcttacttccttgttagaactttgtgctgctgaccaccactctgaaccaaaacttctttcttggttcttgaaagttgctgtctttctcctccagagggtctgtgtcttccttccaactcttaaacatttttgtttcccagaatccatcattggccattgctttttcacttgccatgagctctgtgaatgagatggttcctgctgaagacatttactttcaatgatctacagaatttcccaaatctatgtctccagactggatgtttctcacgtctgtggcccactgggcatcttctgcactttctctgcatttgtaaacactgagcctgtatgcgtgtctatgtggccatggccctggccgtggggatgcacccataattataatgagagcaggtgaatgtcatgtggctatgtatgagacattgttgtgaatgttttacatgcatcagctctttcaacatttacagcatctgtgtgtggtaggtaatgttgtttccttcattttgcagagcagaatatagataggctcaggttaagaatttgcccaaggttacacagttatgaagtttggatttaggaatgggaggccacgtagactggcttcagaattcatgtctttaaccactttattgcttctcatgttggggggtttgttttctggtcactatttttactaaagttgattcaacaatgctataatctgttactctcattcgacaatacatcttgactgtttcttcaacttgaggaaggtaaaccaaagccactctttaatgggtgcaaatatctgttgtaactatgtagaagatacagtgtctgggtttgaggacaggggagtgggaaaactgagtagggaagcggtaagacatgcatctggctttaggagtgtttgaagtgcctaaagatcagggtgaatttcccaaatttgaatcttgttgcccaagccacattgcaaccacctctttttctcttacctcgtccccacatccaggcactgccccattctgttcattccacctttttttttagtagaccctccatatatgtgtgtgttttggtgaatggccacacacagcaaagttatttttattgcaattttgttgttgttgtttgagacacagagtctcatactctgccacccagactgaagtgcagtggtgcgatctcagttcactgcaacctccatccccccatgttcaagcaattctcctgcctcagcctcccaagtagctgggattacaggcatgggccaccatgcccggctaatttttgtattttttgtagacacggggtttcaccatgttggccaggctggtctcacactcctgacctcaggtgatccacccgcctcggcctcccgaagtgctggcattacaggcatgagccaccacacccagcctttattgcaatttttggttccctcacagaatgtttaccatgaagctgtgcgtataggtggtaccatgtatgacataccttgacctcaaagataatctacctgggctttttttgtttgtttgttttgagatggagtctcactctgtcacccatgctggtgtgcagtggcgtgatcttggctcacagcagcctctgcctcccgggttcaagcgattctcctgcctcagcctcctgagtagctgggactacaggtgcctgcgaccacacccagctaatttttgtatttttagtagtagtgggatttcaccatgttggccaggatggcctccacctcctgacttcatgatccacccgcctcggcctcccaaagtgctgggattacaggcgtgagccaccgcacctggcctaatggcagtgtttttaaaatttggattgtcagcagttggcctttgttgagaaaatgtgtgactttgcccaagcccagtaacttggagccttgaatttgagatgctggaaagggagtccttcctcctttctgcagtgtttgtctgggttgtcccctagtttaccaaagtccattttgaatgtaccatccccagcccaactccagcctacagatagtgccagaccgcagtaggtggagtagca

SEQ ID NO: 425675 - DNA, 2264 bp, Homo sapiens
gaagaagcgggaattctaacggctgagctcttggaagacttgggtccttgggtcgcacgggccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 425676 - DNA, 2143 bp, Homo sapiens
gaagaagcgggaattctaacggctgagctcttggaagacttgggtccttgggtcgcacgggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 425677 - DNA, 2066 bp, Homo sapiens
gaagaagcgggaattctaacggctgagctcttggaagacttgggtccttgggtcgcacggggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctcgaaccttgcctccagattatgaaccagtataagtagcacaattctcgtggctactttcacttcagagtgtcatgtttattgatgtggagctttctgaatagggaggttaaggcacacctgctgagtaaaacaaatatttcttgtgtagcgttcttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 425678 - DNA, 2121 bp, Homo sapiens
gaagaagcgggaattctaacggctgagctcttggaagacttgggtccttgggtcgcacggggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagccccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 425679 - DNA, 987 bp, Homo sapiens
ctctacctccatttagggatttgcttgggatacagaagaggccatgtgttcctatttttcacactctcatatgggagataagtggttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtcagaaaaaacacacagaccccacaaaccacacacaacccacccaaccaccacaacacacaaaccaaagcacaccacacccacaccccacacacgcaccacctcccacccaccagacacaccactcccccacacccacacacaccacacaacaccgcccacccccacacaccccaccaccccccgcgagacagtcacaacgccacacactcgaagagcagtcggacagacctagcccgagaagacaacaaacaataagaagactacgatcaagcaaaaaacagcaacccggcgactaacaggcactctggcatcaaccaccctacaacgaggacacaacagccaacacacccacatgcgagaccacgagaaaaagcgaaggaagcaaaagactacccagatagagcaataccacatctacaaaaagccgagcacagacagacgcgcgcaaaagcgagcgcagaaagacagacgaatcgcggcacatgacacacgtgc

SEQ ID NO: 425680 - DNA, 2045 bp, Homo sapiens
gaagaagcgggaattctaacggctgagctcttggaagacttgggtccttgggtcgcacgggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 425681 - DNA, 2253 bp, Homo sapiens
gaagaagcgggaattctaacggctgagctcttggaagacttgggtccttgggtcgcacggggtctcactccattgcccaggccagagtgcggggatatttgataagaaacttcagtgaaggccgggcgcggtggctcatgcccgtaatcccagcattttcggaggccgaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 425682 - DNA, 2472 bp, Homo sapiens
gaagaagcgggaattctaacggctgagctcttggaagacttgggtccttgggtcgcacgggccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagagggtctcactccattgcccaggccagagtgcggggatatttgataagaaacttcagtgaaggccgggcgcggtggctcatgcccgtaatcccagcattttcggaggccgaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 425683 - DNA, 2096 bp, Homo sapiens
gaagaagcgggaattctaacggctgagctcttggaagacttgggtccttgggtcgcacgggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtcaaaaaaaaaaaacccaccacacacaccgcaacaacaggggggggccccaaa

SEQ ID NO: 425684 - DNA, 2155 bp, Homo sapiens
gaagaagcgggaattctaacggctgagctcttggaagacttgggtccttgggtcgcacggggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 425685 - DNA, 2272 bp, Homo sapiens
gaagaagcgggaattctaacggctgagctcttggaagacttgggtccttgggtcgcacgggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtcaaaaaaagaaacagcagcaaaaaaaaccgccaggggaattctagtgcacgggctgcgggaacaaagaggctcacgcaatggcccatggggccaatacacggttacctagacccagtttcgcgtgtcaccaacgtgggtacaactccgcggggacaccccaaaaaaggaacggcgaactaaatttgcaataaacccaggagaacccggcttaatggaacgcggcgaaa

SEQ ID NO: 425686 - DNA, 2540 bp, Homo sapiens
gaagaagcgggaattctaacggctgagctcttggaagacttgggtccttgggtcgcacgggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtcagaaaaaacacacagaccccacaaaccacacacaacccacccaaccaccacaacacacaaaccaaagcacaccacacccacaccccacacacgcaccacctcccacccaccagacacaccactcccccacacccacacacaccacacaacaccgcccacccccacacaccccaccaccccccgcgagacagtcacaacgccacacactcgaagagcagtcggacagacctagcccgagaagacaacaaacaataagaagactacgatcaagcaaaaaacagcaacccggcgactaacaggcactctggcatcaaccaccctacaacgaggacacaacagccaacacacccacatgcgagaccacgagaaaaagcgaaggaagcaaaagactacccagatagagcaataccacatctacaaaaagccgagcacagacagacgcgcgcaaaagcgagcgcagaaagacagacgaatcgcggcacatgacacacgtgc

SEQ ID NO: 425687 - DNA, 2374 bp, Homo sapiens
gaagaagcgggaattctaacggctgagctcttggaagacttgggtccttgggtcgcacgggccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagagggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 425688 - DNA, 1770 bp, Homo sapiens
gaagaagcgggaattctaacggctgagctcttggaagacttgggtccttgggtcgcacgggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacaga

SEQ ID NO: 425689 - DNA, 1145 bp, Homo sapiens
agcctccctccgttttcaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 425690 - DNA, 1148 bp, Homo sapiens
gaagaagcgggaattctaacggctgagctcttggaagacttgggtccttgggtcgcacgggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggcgagctgagaaaggggacccgagctgaagagtagcaagaaaaggggagcccttgggacacccccgacacaagatacggggacacacgatggcaaggagagcccaaagggaacccacaagccaaaataccggaaaacacaacaaacgacggagaaggagcgaaacgccacaacgca

SEQ ID NO: 425691 - DNA, 820 bp, Homo sapiens
gaagaagcgggaattctaacggctgagctcttggaagacttgggtccttgggtcgcacgggccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagagggtctcactccattgcccaggccagagtgcggggatatttgataagaaacttcagtgaaggccgggcgcggtggctcatgcccgtaatcccagcattttcggaggccgaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattactgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacaga

SEQ ID NO: 425692 - DNA, 2796 bp, Homo sapiens
agtatagcagtaaatagcaccgtccttggaaataggcagactgtttttgctagttgtggaaccgtggacaagtttagtctaaaacttagtttatgtaaaaggaggacattgattcctacctcaaagggctgttagatgctcaagaagtgacaatacaaatgcctatgaagaaacaggatcaggatcccgccccaaccagcgccaggccacgccccggcgtgtgacgcaagcacgctccgtgcgcgccgtcgcgtcgcggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcctgccattctgtttttataagtggctacacttgccttctgaatgattgaaagaaacttttacatcttttcttccaaaataaaagtaacaagctgactgtgattcttaaattgagaccagagcagcaaacgtctcactttaaatttttgttttcttttcctttttttttcttttttctttttttttttttttttgcacagggcatggcttgaattagttttatttttcttaactttaaatatatatatgaaaatatatattaaaatgttctctaaatattttctgcttcttgcaggtctctttttactagatcatggctgttcttcccacctcatccctctgaaaataaaaatgtattgccctccccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttccttttttttttaattaaataaatggatcaaattaaataattcaagccctgccttcaaaatgaaattttttttttagtattatttagcaaaaacaataaaacccaaatttttttaaccatcactcatgtctcaggtttgtgcgtccttcagaggccccaggggagaggatccaaggtatgtctgtctggtttgacctttctctttagagtctcttcttcctactatttaccctctcttttcacccccgaggactcatccagaaatataatgcagggtataatttaagatgagggtccagggtttggagtggtgtgtaggtggagtgtggggaaaaggctgtagtcacatacatagaaccatttgttacaggactgtttggaggcacaaatggtcggcgagctgagaagtaaactttcagatccacctgc

SEQ ID NO: 425693 - DNA, 1756 bp, Homo sapiens
  misc_feature (1520)..(1520): n is a, c, g, or t
agtatagcagtaaatagcaccgtccttggaaataggcagactgtttttgctagttgtggaaccgtggacaagtttagtctaaaacttagtttatgtaaaaggaggacattgattcctacctcaaagggctgttagatgctcaagaagtgacaatacaaatgcctatgaagaaacaggatcaggatcccgccccaaccagcgccaggccacgccccggcgtgtgacgcaagcacgctccgtgcgcgccgtcgcgtcgcggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcctgccattctgtttttataagtggctacacttgccttctgaatgattgaaagaaacttttacatcttttcttccaaaataaaagtaacaagctgactgtgattcttaaattgagaccagagcagcaaacgtctcactttaaatttttgttttcttttcctttttttttcttttttctttttttttttttttttgcacagggcatggcttgaattagttttatttttcttaactttaaatttttttttgacaccttttttttaacggngttccccaaaaaagaacacaacacactgaacaactaaaccactgtttgtaggggctcctggccccgaaaaaagttagtaacaacacattgtgtgggaccgcgcccgagtagataagagacaccgtgtcagcggtcgcagagaaccgtgtcaaactaggcgtgggtcccccaaaaaagcgcgcggggaccagaggtctgacacaccaagggccggcccagggtacaggtcagacgag

SEQ ID NO: 425694 - DNA, 805 bp, Homo sapiens
ttacttcatggtactagaagacaggcagagggagaatcctgaggtttgggccaaatgtgagactggtacacacacagttaaagactaaaaagcctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttccttttttttttaattaaataaatggatcaaattaaataattcaagccctgccttcaaaatgaaattttttttttagtattatttagcaaaaacaataaaacccaaatttttttaaccatca

SEQ ID NO: 425695 - DNA, 850 bp, Homo sapiens
agtatagcagtaaatagcaccgtccttggaaataggcagactgtttttgctagttgtggaaccgtggacaagtttagtctaaaacttagtttatgtaaaaggaggacattgattcctacctcaaagggctgttagatgctcaagaagtgacaatacaaatgcctatgaagaaacaggatcaggatcccgccccaaccagcgccaggccacgccccggcgtgtgacgcaagcacgctccgtgcgcgccgtcgcgtcgcggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaaggtgctgggaaatgccaggatgattaaaacacccctcttgccctccagaatctcacatttgttgggagtggtgagggacagcagcatttaacttagtgataacaatatggtgagacccgctctgcactagtggtcatatgtccaagagagtttcgctcttgttgcccagcctggagttcaatggcacggtctcagctcactgcaacctccacctcccgggttcaagcgattctcctgcctcagcctcccaagtagctgggattac

SEQ ID NO: 425696 - DNA, 138 bp, Homo sapiens
aaagaggggagtgcactgagccatgtacgcaaaatagtaagtaaaggagccttcagactttaggggagagaggatggttcctcaggccttcagtctttagcaccagaccaggacattgtgctacagtctctgcctcct

SEQ ID NO: 425697 - DNA, 336 bp, Homo sapiens
agctcttccagaccattcacaagacgtgagttgggatcggagaggtcctttgtcctggggtaatgctacctggttgtgctgtctggtggcaggcttttgggtggttgtcttcctaaaagtctactggggaagctgggtagggtattggcaatatgccagcatccagaggtgcaggtgctgtagccccctttccacacagaagaatagtgtaatcacggacaagttgtcttctctggtctttagttgcttgtctgtaaaacttagttttggattagattatccctaaggatcccttctagacctagtagtccataacttagaactagtgatttcttc

SEQ ID NO: 425698 - DNA, 2489 bp, Homo sapiens
agtatagcagtaaatagcaccgtccttggaaataggcagactgtttttgctagttgtggaaccgtggacaagtttagtctaaaacttagtttatgtaaaaggaggacattgattcctacctcaaagggctgttagatgctcaagaagtgacaatacaaatgcctatgaagaaacaggatcaggatcccgccccaaccagcgccaggccacgccccggcgtgtgacgcaagcacgctccgtgcgcgccgtcgcgtcgcggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcctgccattctgtttttataagtggctacacttgccttctgaatgattgaaagaaacttttacatcttttcttccaaaataaaagtaacaagctgactgtgattcttaaattgagaccagagcagcaaacgtctcactttaaatttttgttttcttttcctttttttttcttttttctttttttttttttttttgcacagggcatggcttgaattagttttatttttcttaactttaaatatatatatgaaaatatatattaaaatgttctctaaatattttctgcttcttgcaggtctctttttactagatcatggctgttcttcccacctcatccctctgaaaataaaaatgtattgccctccccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttccttttttttttaattaaataaatggatcaaattaaataattcaagccctgccttcaaaatgaaattttttttttagtattatttagcaaaaacaataaaacccaaatttttttaaccatca

SEQ ID NO: 425699 - DNA, 888 bp, Homo sapiens
agtatagcagtaaatagcaccgtccttggaaataggcagactgtttttgctagttgtggaaccgtggacaagtttagtctaaaacttagtttatgtaaaaggaggacattgattcctacctcaaagggctgttagatgctcaagaagtgacaatacaaatgcctatgaagaaacaggatcaggatcccgccccaaccagcgccaggccacgccccggcgtgtgacgcaagcacgctccgtgcgcgccgtcgcgtcgcggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaagaacattttacgagacgtggaaagccgaagaaatactaaatataactctccagacgct

SEQ ID NO: 425700 - DNA, 3399 bp, Homo sapiens
gccgccactgtcgtcgccacgggcagctgggctacttgctcctcgcagctaaaaggcggtgcctccctattaccccctcgcctcccggcccccttccttaatggatgaaaagtacccctccctctacatctgctgtacctaaggacaggactctgaggagtactcttgctccacagattaaactctcagcagcaacttcaagaatcatttttctataggggtctgggaggaattctggaggagagtaaagtcgaagttcttagaagctctgagaaatcatgggccgtgcggtaggggttgaaatgctcaaaggtccacacttcttgaaataaacagaatggtcttgagtggattgcaactgttttggaaatagctttgtgaaaagagggtggagagctactcaaaattctacgttagagagactgaaaagacatctaatttcattgctcggcagactgctctccagaatgttgagattgcccgagaagtgaccccagcaaaagaaaaatattgctgtacctaaattcaaacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacaagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggctgtcctttggaggtataaattctctcagcttaaaggttcttcagatgatggcaagagcaaaatcaaatttttgtttcagaatccagatactaaacagattgaagcaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtataagcaggacacatttactcatcattttagaccctagagaaaccataacatcaccaagtcgacagtggaggcaaatcaaaatttcggcagaaaaagaaggtcatgtggaacctcaaaaacacttctattctggatgacatctgtgaaatatactacatgaacagaacagcttgttctcactcagttgctttgtaccagtaagtgtattgctttcaccaaaagtggagacaaaagaataaattatttgaagaagtatgtaaataacataaaaatagtaagctacctatgaataaaaatacttattaaatgattacttctgtattttagattattttgtatgactagtacatgttgggcagagtcataggaaaacaaatgccctatcttgtattatgagggacataaaagagttaaaaaccataaatcagcaaggagcatgcaaaaaaatctcatcaaagaaggatgcactttaatttgctgatgtaaatttgcccttgtgttctcatcccatgatttgacactggcattccaattgtttttatcttattgtaaatattccgaagaacttccaaaggataattacattgacccatgatagatacaatgtgaaatggactattctcccttggatcactgttattgaaatgtcttattagctgccaaagtcaatcaaatatgccaacagtgtattaatttaattatgagtgatggaaaatttcatgaacctctcatttcttccttggtttgaaagagatttgtattttacctaataagatttattatcaaattaaagtttcataaattttcagtgaacccaaaaccttttgtagagaaaataatataaacaaatatggtgtgagaaacaattctttgtaatccgaagtctactagttaatcatgaactaaaatgtcccccgaaaacagtcccaaagctattatagatgttaattaaatgacattttttcattttagtactattttatgagaaacaaaggtgatatttaaagataaaagttaaaattctttaacctcccttgtcatggaaagtgattaagtaatgccaactatgcaggttgttttaggtattttgtcctaagaatgtaaatgtgaaaggctgggaaatttgaaagccttagaggtgtgcaatttactcagattccaggtattattcaactagttgtataacatggaacacagtctctgtccttcagtacagcttttttgagatattttaaaaagtcagctgtgtatg

SEQ ID NO: 425701 - DNA, 3213 bp, Homo sapiens
gccgccactgtcgtcgccacgggcagctgggctacttgctcctcgcagctaaaaggcggtgcctccctattaccccctcgcctcccggcccccttccttaatggatgaaaagtacccctccctctacatctgctgtacctaaggacaggactctgaggagtactcttgctccacagattaaactctcagcagcaacttcaagaatcatttttctataggggtctgggaggaattctggaggagagtaaagtcgaagttcttagaagctctgagaaatcatgggccgtgcggtaggggttgaaatgctcaaaggtccacacttcttgaaataaacagaatggtcttgagtggattgcaactgttttggaaatagctttgtgaaaagagggtggagagctactcaaaattctacgttagagagactgaaaagacatctaatttcattgctcggcagacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacaagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtataagcaggacacatttactcatcattttagaccctagagaaaccataacatcaccaagtcgacagtggaggcaaatcaaaatttcggcagaaaaagaaggtcatgtggaacctcaaaaacacttctattctggatgacatctgtgaaatatactacatgaacagaacagcttgttctcactcagttgctttgtaccagtaagtgtattgctttcaccaaaagtggagacaaaagaataaattatttgaagaagtatgtaaataacataaaaatagtaagctacctatgaataaaaatacttattaaatgattacttctgtattttagattattttgtatgactagtacatgttgggcagagtcataggaaaacaaatgccctatcttgtattatgagggacataaaagagttaaaaaccataaatcagcaaggagcatgcaaaaaaatctcatcaaagaaggatgcactttaatttgctgatgtaaatttgcccttgtgttctcatcccatgatttgacactggcattccaattgtttttatcttattgtaaatattccgaagaacttccaaaggataattacattgacccatgatagatacaatgtgaaatggactattctcccttggatcactgttattgaaatgtcttattagctgccaaagtcaatcaaatatgccaacagtgtattaatttaattatgagtgatggaaaatttcatgaacctctcatttcttccttggtttgaaagagatttgtattttacctaataagatttattatcaaattaaagtttcataaattttcagtgaacccaaaaccttttgtagagaaaataatataaacaaatatggtgtgagaaacaattctttgtaatccgaagtctactagttaatcatgaactaaaatgtcccccgaaaacagtcccaaagctattatagatgttaattaaatgacattttttcattttagtactattttatgagaaacaaaggtgatatttaaagataaaagttaaaattctttaacctcccttgtcatggaaagtgattaagtaatgccaactatgcaggttgttttaggtattttgtcctaagaatgtaaatgtgaaaggctgggaaatttgaaagccttagaggtgtgcaatttactcagattccaggtattattcaactagttgtataacatggaacacagtctctgtccttcagtacagcttttttgagatattttaaaaagtcagctgtgtatg

SEQ ID NO: 425702 - DNA, 503 bp, Homo sapiens
  misc_feature (35)..(35): n is a, c, g, or t
gataatgattagtgttccgtttatgtaacaacgtnccttgacggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggtaatgtgttcaggtcagctctgagaaatatgctgcaaacattctaattgaagaatgatttaaatgcctcataactcctttcagcattttaattgtaatcgtgtcaaatttaagatcttcgtttttgttaatggaagataaattatgcttcgatctgaaaaaaagtttgaatttttaataaaacatatgtagtaccacaaaactaaaaaaaaat

SEQ ID NO: 425703 - DNA, 2054 bp, Homo sapiens
gccgccactgtcgtcgccacgggcagctgggctacttgctcctcgcagctaaaaggcggtgcctccctattaccccctcgcctcccggcccccttccttaatggatgaaaagtacccctccctctacatctgctgtacctaaggacaggactctgaggagtactcttgctccacagattaaactctcagcagcaacttcaagaatcatttttctataggggtctgggaggaattctggaggagagtaaagtcgaagttcttagaagctctgagaaatcatgggccgtgcggtaggggttgaaatgctcaaaggtccacacttcttgaaataaacagaatggtcttgagtggattgcaactgttttggaaatagctttgtgaaaagagggtggagagctactcaaaattctacgttagagagactgaaaagacatctaatttcattgctcggcagactgctctccagaatgttgagattgcccgagaagtgaccccagcaaaagaaaaatattgctgtacctaaattcaaacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacaagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggtaatgtgttcaggtcagctctgagaaatatgctgcaaacattctaattgaagaatgatttaaatgcctcataactcctttcagcattttaattgtaatcgtgtcaaatttaagatcttcgtttttgttaatggaagataaattatgcttcgatctgaaaaaaagtttgaatttttaataaaacatatgtagtaccacaaaactaaaaaaaaat

SEQ ID NO: 425704 - DNA, 839 bp, Homo sapiens
atttgttctgaacatctgcaggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacaagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggtaatgtgttcaggtcagctctgagaaatatgctgcaaacattctaattgaagaatgatttaaatgcctcataactcctttcagcattttaattgtaatcgtgtcaaatttaagatcttcgtttttgttaatggaagataaattatgcttcgatctgaaaaaaagtttgaatttttaataaaacatatgtagtaccacaaaactaaaaaaaaat

SEQ ID NO: 425705 - DNA, 1408 bp, Homo sapiens
caaatattcttaaaagatagatttagttattgtattttggtctacaattttggacttggcagtttgttttactaatgcagaattattctttttgtttcaaacatagtttgccatcatctggctactacctaatcatgttgtactagttattgtggaaagaaaattgtacatacatttccttgtcctttgggagatgtctttgagtcaaacccacaagcatgaactctcacctgaaagaaaactggaaaaggagaaactttaaatcagtatgttttgaaaggaagagatttccagactttttaaagcaaattggaatcgttttatttttttgtttgggccttaggcacaatagaagcaaatgttgcaatattaaatataatagggagagttcactgtttcctgggacattgtggtcatgtccttaatccttcattgtgatgccccttcttggagttggcattttgtgacaattcatagagatcttgcagcaatatttggctattggttttattaacttaaaattcaacagaaatggagtaattaaaaaaaaaaacaaaaaacagagaagaattgcaaaatctgaagtggaatggcacttccttgggtatgtaagggttgtttttagataaaactcccgatttgttcttcctacactttaatagtctcaaattctttctggggaagcaacgtcagtgtctacctccacagtaactatgatataggaaattgtcctttcagtggtttctaggtataacaaacaagccgttaaaaatgagtgaccattttgtaggttacagcctcagcaatctgtgtcatttgaaagcaaatatcctgatatttttaaataaggtgagcagggcaggcaggaaaccaatatttagtacttttgtgattaaacattctagaccaggcttgttgatatgtatgccaatagcctagaatttttggcttagtgtaaaataaaaatgtcttttctattgtggtctgatatccgtttctgtaataagatcagtttgttgtcctctgtgcaccagtggttttgcccttaattttttttggctagcatcaccaagatctgtcatccagagctgctgagaaaaatacatgttgccaaacttttcttaaaattgtgctgccagtggtattttcccagatgtgaaaaataataatctaataaaggattaatatctaataacaataccattgttgaacatgctcatggaatgtccaccttcttctgattcctttttttgtatttgaaaatgcaatggtgtgttccaaattattgttggtgttgttaatgtcatgactctcctttgaatagaataaaataaccccttttgttttgtgttttctactgaattagattttcctctagtcctatgtgaataaaaagctatttgaaata

SEQ ID NO: 425706 - DNA, 3564 bp, Homo sapiens
ccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaagtagacaatcattccaagggtacaacaaggtttaccacaatgtgagggactcagccattgcaaattgtacagatgagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagcggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgta

SEQ ID NO: 425707 - DNA, 3368 bp, Homo sapiens
ccgacccgctaggccccgcgcggctcggatccggcggcgctgtttcggtcgggagtgggtgggagagaagccggggcaggggaggagccgccggagctgtcggagccggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagcggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgta

SEQ ID NO: 425708 - DNA, 652 bp, Homo sapiens
ccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaagctataccctttttgtactctgtgtatatactatattgcagtagacaatcattccaagggtacaacaaggtttaccacaatgtgagggactcagccattgcaaattgtacagatgagtcttcagtggaaacctggtactcctcagattcctctggttcaacaggcggggatcccatcccttatcatctcctcaaatgctaaaggacccttgagcaaagccaggaggaagtcatctagacgtgaaacagggagtatccacacaggctgtgttaatgacaaagctaaaaacatagtaaatgacttttgaatttactgctgttatgaattatctatagcaacacctccggtcagctctgttatatatgttattgcgttatttcccattaaatgatggttcctctgactatctgattggcattgactatg

SEQ ID NO: 425709 - DNA, 515 bp, Homo sapiens
aggagaaatagaaagcttaaactcaatgtgcgtttattgaataccttttctactaagggctcgacaaagtggtaggcactgggaatataaaaatgaataaggagacccttgctctcgagggcagggcccacagtggggagacagacgttaagccatgcccacgacaagaatgacttctgagattccttctttggatcatgatttagtcttcagtggaaacctggtactcctcagattcctctggttcaacaggcggggatcccatcccttatcatctcctcaaatgctaaaggacccttgagcaaagccaggaggaagtcatctagacgtgaaacagggagtatccacacaggctgtgttaatgacaaagctaaaaacatagtaaatgacttttgaatttactgctgttatgaattatctatagcaacacctccggtcagctctgttatatatgttattgcgttatttcccattaaatgatggttcctctgactatctgattggcattgactatg

SEQ ID NO: 425710 - DNA, 4252 bp, Homo sapiens
  misc_feature (3921)..(3921): n is a, c, g, or t
  misc_feature (3939)..(3939): n is a, c, g, or t
  misc_feature (3976)..(3976): n is a, c, g, or t
ccgacccgctaggccccgcgcggctcggatccggcggcgctgtttcggtcgggagtgggtgggagagaagccggggcaggggaggagccgccggagctgtcggagccggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagcggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgtatttgtgttgtttgctttttcttacgtgattttatgttcatagagctagaaagtagcatctcatgatggcccaacaatctctgttgccagttaaaggttccttggagatgaggctgaataattatgaacctcaccttctctgattgtgggagtggcaagaactggggagacgtcctccataagtggagcacagggtatggggttaaagcatgacagggagagtcttctgtgcctggtttcttctcctctatctcataatgcattatgggcccgaggaataggggagggttaataagactccaaccctaatggcccaacagggaaattctcattttggtcgatgatattctgatggactggtttggtcttaataccagtcaaccgttgtccttctggaaatatacatatatgaaataaataaaggtaacacttgcagccaagttccctggtttctgggacttcccatcttacccattccttttccagggcttccagtgtcctgatacttctggagggtggttcatactccaaattagattctggggagttacagnagtaattttttccttggnagggaaagggaagggttgggggatggatttaggcagnagttccggtggaaacattatttgcactctgagataagatccaagcctggagtttgcagaagatactgtcctaataagcaggcatttctaaaccaagtatctaagcctaagcacagcttgtcctgggtgaaatgtctgccacaaaagatagtttctcctagctcagacttaaccatttataaaggttggtaaaatactggcagtgacaacaaattgactttttaattttcttatttgcattattccaataaatgaaaatctgtcagagttcgtacat

SEQ ID NO: 425711 - DNA, 4448 bp, Homo sapiens
  misc_feature (4117)..(4117): n is a, c, g, or t
  misc_feature (4135)..(4135): n is a, c, g, or t
  misc_feature (4172)..(4172): n is a, c, g, or t
ccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaagtagacaatcattccaagggtacaacaaggtttaccacaatgtgagggactcagccattgcaaattgtacagatgagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagcggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgtatttgtgttgtttgctttttcttacgtgattttatgttcatagagctagaaagtagcatctcatgatggcccaacaatctctgttgccagttaaaggttccttggagatgaggctgaataattatgaacctcaccttctctgattgtgggagtggcaagaactggggagacgtcctccataagtggagcacagggtatggggttaaagcatgacagggagagtcttctgtgcctggtttcttctcctctatctcataatgcattatgggcccgaggaataggggagggttaataagactccaaccctaatggcccaacagggaaattctcattttggtcgatgatattctgatggactggtttggtcttaataccagtcaaccgttgtccttctggaaatatacatatatgaaataaataaaggtaacacttgcagccaagttccctggtttctgggacttcccatcttacccattccttttccagggcttccagtgtcctgatacttctggagggtggttcatactccaaattagattctggggagttacagnagtaattttttccttggnagggaaagggaagggttgggggatggatttaggcagnagttccggtggaaacattatttgcactctgagataagatccaagcctggagtttgcagaagatactgtcctaataagcaggcatttctaaaccaagtatctaagcctaagcacagcttgtcctgggtgaaatgtctgccacaaaagatagtttctcctagctcagacttaaccatttataaaggttggtaaaatactggcagtgacaacaaattgactttttaattttcttatttgcattattccaataaatgaaaatctgtcagagttcgtacat

SEQ ID NO: 425712 - DNA, 3806 bp, Homo sapiens
ccgacccgctaggccccgcgcggctcggatccggcggcgctgtttcggtcgggagtgggtgggagagaagccggggcaggggaggagccgccggagctgtcggagccggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagcggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgtatttgtgttgtttgctttttcttacgtgattttatgttcatagagctagaaagtagcatctcatgatggcccaacaatctctgttgccagttaaaggttccttggagatgaggctgaataattatgaacctcaccttctctgattgtgggagtggcaagaactggggagacgtcctccataagtggagcacagggtatggggttaaagcatgacagggagagtcttctgtgcctggtttcttctcctctatctcataatgcattatgggcccgaggaataggggagggttaataagactccaaccctaatggcccaacagggaaattctcattttggtcgatgatattctgatggactggtttggtcttaataccagtcaaccgttgtccttctggaaatatacatatatgaaataaataaaggtaacacttgcagcca

SEQ ID NO: 425713 - DNA, 4488 bp, Homo sapiens
  misc_feature (4157)..(4157): n is a, c, g, or t
  misc_feature (4175)..(4175): n is a, c, g, or t
  misc_feature (4212)..(4212): n is a, c, g, or t
ccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaagctataccctttttgtactctgtgtatatactatattgcagtagacaatcattccaagggtacaacaaggtttaccacaatgtgagggactcagccattgcaaattgtacagatgagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagcggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgtatttgtgttgtttgctttttcttacgtgattttatgttcatagagctagaaagtagcatctcatgatggcccaacaatctctgttgccagttaaaggttccttggagatgaggctgaataattatgaacctcaccttctctgattgtgggagtggcaagaactggggagacgtcctccataagtggagcacagggtatggggttaaagcatgacagggagagtcttctgtgcctggtttcttctcctctatctcataatgcattatgggcccgaggaataggggagggttaataagactccaaccctaatggcccaacagggaaattctcattttggtcgatgatattctgatggactggtttggtcttaataccagtcaaccgttgtccttctggaaatatacatatatgaaataaataaaggtaacacttgcagccaagttccctggtttctgggacttcccatcttacccattccttttccagggcttccagtgtcctgatacttctggagggtggttcatactccaaattagattctggggagttacagnagtaattttttccttggnagggaaagggaagggttgggggatggatttaggcagnagttccggtggaaacattatttgcactctgagataagatccaagcctggagtttgcagaagatactgtcctaataagcaggcatttctaaaccaagtatctaagcctaagcacagcttgtcctgggtgaaatgtctgccacaaaagatagtttctcctagctcagacttaaccatttataaaggttggtaaaatactggcagtgacaacaaattgactttttaattttcttatttgcattattccaataaatgaaaatctgtcagagttcgtacat

SEQ ID NO: 425714 - DNA, 4372 bp, Homo sapiens
  misc_feature (4041)..(4041): n is a, c, g, or t
  misc_feature (4059)..(4059): n is a, c, g, or t
  misc_feature (4096)..(4096): n is a, c, g, or t
ccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagcggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgtatttgtgttgtttgctttttcttacgtgattttatgttcatagagctagaaagtagcatctcatgatggcccaacaatctctgttgccagttaaaggttccttggagatgaggctgaataattatgaacctcaccttctctgattgtgggagtggcaagaactggggagacgtcctccataagtggagcacagggtatggggttaaagcatgacagggagagtcttctgtgcctggtttcttctcctctatctcataatgcattatgggcccgaggaataggggagggttaataagactccaaccctaatggcccaacagggaaattctcattttggtcgatgatattctgatggactggtttggtcttaataccagtcaaccgttgtccttctggaaatatacatatatgaaataaataaaggtaacacttgcagccaagttccctggtttctgggacttcccatcttacccattccttttccagggcttccagtgtcctgatacttctggagggtggttcatactccaaattagattctggggagttacagnagtaattttttccttggnagggaaagggaagggttgggggatggatttaggcagnagttccggtggaaacattatttgcactctgagataagatccaagcctggagtttgcagaagatactgtcctaataagcaggcatttctaaaccaagtatctaagcctaagcacagcttgtcctgggtgaaatgtctgccacaaaagatagtttctcctagctcagacttaaccatttataaaggttggtaaaatactggcagtgacaacaaattgactttttaattttcttatttgcattattccaataaatgaaaatctgtcagagttcgtacat

SEQ ID NO: 425715 - DNA, 606 bp, Homo sapiens
ccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaagctataccctttttgtactctgtgtatatactatattgcagtagacaatcattccaagggtacaacaaggtttaccacaatgtgagggactcagccattgcaaattgtacagatgaggcggggatcccatcccttatcatctcctcaaatgctaaaggacccttgagcaaagccaggaggaagtcatctagacgtgaaacagggagtatccacacaggctgtgttaatgacaaagctaaaaacatagtaaatgacttttgaatttactgctgttatgaattatctatagcaacacctccggtcagctctgttatatatgttattgcgttatttcccattaaatgatggttcctctgactatctgattggcattgactatg

SEQ ID NO: 425716 - DNA, 3527 bp, Homo sapiens
ccgcccctcggcgtgaccccctcgcccccgtcgcacacggcggggcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagcagctgttttctctcctggattcgtatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcaca

SEQ ID NO: 425717 - DNA, 5184 bp, Homo sapiens
ccgcccctcggcgtgaccccctcgcccccgtcgcacacggcggggcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagcagctgttttctctcctggattcgtatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaaggctcactggatgtaaatgtaaaacttcgcgactttataaaactggcattcctaggggaggggctatttatcctacaggtccctgcctcctggcagtgccatggtatgtgtgcatggatataccagacacagtcaccatcggccatcagtagcagcccatgaacccacgtgcacatcctgcatcttgctcttctgacccttcattcccacttgtcttcaggcaggcatttctgggatctaaactagaaatccttgaaaacaaatagtaccagccactttgaggaatgtgcattcactgtagtgggttattatggggtctctgcctcctggctgtgttatgcggagcccaggagtggaggagagccgtggaaatagacagggagaggctggtacttgggttgtggtaatagtcaggcttgccacaagagggcactcatagatttgtttttatattcattcttgagaaaaaagcaactggttactgaacgtaactcatgacttatgtttcaaattttgcatagctgattttaagtcattttgatagctttgcaagaaaaatttttcctttgaaacaagggagtagggctgtttcattttctttccttctaatcctcatgccaagaggtgagaaacacttaaggtcatttaaggtgctagggaaagggttttcccatggagctttctgtgaggcgcagtaaaatagagccagcagcaaagtagaggaaaaagccagactgcgtcacacaagatttctcatccttttcaggagagagtcactgtgtagatttgaatcttttttctttgagtctgctttgaactttagcaggcttttcctaagactgacaattgtcgtcttaaatcagagatttgagggtagacttattttatggcaaatgtctatttttctgatataaaagtaacaatgctcattacagaagaatctaaacaaagaataaaaattagccatcttctctccatctaaaacagagctaaactttgctgatatgtttatgaatttcctttcagtattaaaaagtgcatataaggtgtatatttacacaaaattgaaggtcatacatagatacaggttggtatcctaactttaccctctcactgattaacatggtatcacgagtaacttcctatgtttttaaatctttgaaaatagatttctagtggttctaccttatccatccccacactgttgaaaattttggttgtttcagatacttttattatcaatgatgatgtgataaagtttcttgtatatatctctttggctctatctttggtaatttcttaagaatggaatcttagaattggactgtgaagagggggattcacattgctggggctaagtacaaattgacatcaccttttaggaatgaaatgcttctctttgaccctttagctccagtgtcccagcatagtcactgggcttcataggagtagcagtgagaggacagtgtcacagcaagggcctctctgcatgctccctgatcattgtgtttgcaggttcagcatttcttcttgagtccttcccttcttccaaccttattgcctcatttcccccttgtagtcaatgttttttggaaacactgtttattttaaaataaaaatgtaaaaaaaaggtaaaaaaataaaattttaaatttt

SEQ ID NO: 425718 - DNA, 4490 bp, Homo sapiens
agcgtgattgctgttgaagataactgtcagtctataccttgattctttgtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaaggctcactggatgtaaatgtaaaacttcgcgactttataaaactggcattcctaggggaggggctatttatcctacaggtccctgcctcctggcagtgccatggtatgtgtgcatggatataccagacacagtcaccatcggccatcagtagcagcccatgaacccacgtgcacatcctgcatcttgctcttctgacccttcattcccacttgtcttcaggcaggcatttctgggatctaaactagaaatccttgaaaacaaatagtaccagccactttgaggaatgtgcattcactgtagtgggttattatggggtctctgcctcctggctgtgttatgcggagcccaggagtggaggagagccgtggaaatagacagggagaggctggtacttgggttgtggtaatagtcaggcttgccacaagagggcactcatagatttgtttttatattcattcttgagaaaaaagcaactggttactgaacgtaactcatgacttatgtttcaaattttgcatagctgattttaagtcattttgatagctttgcaagaaaaatttttcctttgaaacaagggagtagggctgtttcattttctttccttctaatcctcatgccaagaggtgagaaacacttaaggtcatttaaggtgctagggaaagggttttcccatggagctttctgtgaggcgcagtaaaatagagccagcagcaaagtagaggaaaaagccagactgcgtcacacaagatttctcatccttttcaggagagagtcactgtgtagatttgaatcttttttctttgagtctgctttgaactttagcaggcttttcctaagactgacaattgtcgtcttaaatcagagatttgagggtagacttattttatggcaaatgtctatttttctgatataaaagtaacaatgctcattacagaagaatctaaacaaagaataaaaattagccatcttctctccatctaaaacagagctaaactttgctgatatgtttatgaatttcctttcagtattaaaaagtgcatataaggtgtatatttacacaaaattgaaggtcatacatagatacaggttggtatcctaactttaccctctcactgattaacatggtatcacgagtaacttcctatgtttttaaatctttgaaaatagatttctagtggttctaccttatccatccccacactgttgaaaattttggttgtttcagatacttttattatcaatgatgatgtgataaagtttcttgtatatatctctttggctctatctttggtaatttcttaagaatggaatcttagaattggactgtgaagagggggattcacattgctggggctaagtacaaattgacatcaccttttaggaatgaaatgcttctctttgaccctttagctccagtgtcccagcatagtcactgggcttcataggagtagcagtgagaggacagtgtcacagcaagggcctctctgcatgctccctgatcattgtgtttgcaggttcagcatttcttcttgagtccttcccttcttccaaccttattgcctcatttcccccttgtagtcaatgttttttggaaacactgtttattttaaaataaaaatgtaaaaaaaaggtaaaaaaataaaattttaaatttt

SEQ ID NO: 425719 - DNA, 3438 bp, Homo sapiens
agcattcttcatccattatcagctggatggtagtgcccctctcgtgggagctgaacattatgaagtggccttcctgtcagtagagctcagaaccctcaaataccttctgttgggattgcgagtcgtatgttcagactataaaaagggcagagataagaaagaggatgtttcgaaaacaccaaagtaactaaccctttaggagtccttcaacctccccagttacccttggcgcgcagcatttgaagctgtctgtgaggccatcctgcgcttgtttccctcagacactttgtttttcatgttttggcagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaaggctcactggatgtaaatgtaaaacttcgcgactttataaaactggcattcctaggggaggggctatttatcctacaggtccctgcctcctggcagtgccatggtatgtgtgcatggatataccagacacagtcaccatcggccatcagtagcagcccatgaacccacgtgcacatcctgcatcttgctcttctgacccttcattcccacttgtcttcaggcaggcatttctgggatctaaactagaaatccttgaaaacaaatagtaccagccactttgaggaatgtgcattcactgtagtgggttattatggggtctctgcctcctggctgtgttatgcggagcccaggagtggaggagagccgtggaaatagacagggagaggctggtacttgggttgtggtaatagtcaggcttgccacaagagggcactcatagatttgtttttatattcattcttgagaaaaaagcaactggttactgaacgtaactcatgacttatgtttcaaattttgcatagctgattttaagtcattttgatagctttgcaagaaaaatttttcctttgaaacaagggagtagggctgtttcattttctttccttctaatcctcatgccaagaggtgagaaacacttaaggtcatttaaggtgctagggaaagggttttcccatggagctttctgtgaggcgcagtaaaatagagccagcagcaaagtagaggaaaaagccagactgcgtcacacaagatttctcatccttttcaggagagagtcactgtgtagatttgaatcttttttctttgagtctgctttgaactttagcaggcttttcctaagactgacaattgtcgtcttaaatcagagatttgagggtagacttattttatggcaaatgtctatttttctgatataaaagtaacaatgctcattacagaagaatctaaacaaagaataaaaattagccatcttctctccatctaaaacagagctaaactttgctgatatgtttatgaatttcctttcagtattaaaaagtgcatataaggtgtatatttacacaaaattgaaggtcatacatagatacaggttggtatcctaactttaccctctcactgattaacatggtatcacgagtaacttcctatgtttttaaatctttgaaaatagatttctagtggttctaccttatccatccccacactgttgaaaattttggttgtttcagatacttttattatcaatgatgatgtgataaagtttcttgtatatatctctttggctctatctttggtaatttcttaagaatggaatcttagaattggactgtgaagagggggattcacattgctggggctaagtacaaattgacatcaccttttaggaatgaaatgcttctctttgaccctttagctccagtgtcccagcatagtcactgggcttcataggagtagcagtgagaggacagtgtcacagcaagggcctctctgcatgctccctgatcattgtgtttgcaggttcagcatttcttcttgagtccttcccttcttccaaccttattgcctcatttcccccttgtagtcaatgttttttggaaacactgtttattttaaaataaaaatgtaaaaaaaaggtaaaaaaataaaattttaaatttt

SEQ ID NO: 425720 - DNA, 3838 bp, Homo sapiens
aggctttcctttacacttccaggaccaaacagcaacttcctgccacacacttccaccctatcactgggagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaaggctcactggatgtaaatgtaaaacttcgcgactttataaaactggcattcctaggggaggggctatttatcctacaggtccctgcctcctggcagtgccatggtatgtgtgcatggatataccagacacagtcaccatcggccatcagtagcagcccatgaacccacgtgcacatcctgcatcttgctcttctgacccttcattcccacttgtcttcaggcaggcatttctgggatctaaactagaaatccttgaaaacaaatagtaccagccactttgaggaatgtgcattcactgtagtgggttattatggggtctctgcctcctggctgtgttatgcggagcccaggagtggaggagagccgtggaaatagacagggagaggctggtacttgggttgtggtaatagtcaggcttgccacaagagggcactcatagatttgtttttatattcattcttgagaaaaaagcaactggttactgaacgtaactcatgacttatgtttcaaattttgcatagctgattttaagtcattttgatagctttgcaagaaaaatttttcctttgaaacaagggagtagggctgtttcattttctttccttctaatcctcatgccaagaggtgagaaacacttaaggtcatttaaggtgctagggaaagggttttcccatggagctttctgtgaggcgcagtaaaatagagccagcagcaaagtagaggaaaaagccagactgcgtcacacaagatttctcatccttttcaggagagagtcactgtgtagatttgaatcttttttctttgagtctgctttgaactttagcaggcttttcctaagactgacaattgtcgtcttaaatcagagatttgagggtagacttattttatggcaaatgtctatttttctgatataaaagtaacaatgctcattacagaagaatctaaacaaagaataaaaattagccatcttctctccatctaaaacagagctaaactttgctgatatgtttatgaatttcctttcagtattaaaaagtgcatataaggtgtatatttacacaaaattgaaggtcatacatagatacaggttggtatcctaactttaccctctcactgattaacatggtatcacgagtaacttcctatgtttttaaatctttgaaaatagatttctagtggttctaccttatccatccccacactgttgaaaattttggttgtttcagatacttttattatcaatgatgatgtgataaagtttcttgtatatatctctttggctctatctttggtaatttcttaagaatggaatcttagaattggactgtgaagagggggattcacattgctggggctaagtacaaattgacatcaccttttaggaatgaaatgcttctctttgaccctttagctccagtgtcccagcatagtcactgggcttcataggagtagcagtgagaggacagtgtcacagcaagggcctctctgcatgctccctgatcattgtgtttgcaggttcagcatttcttcttgagtccttcccttcttccaaccttattgcctcatttcccccttgtagtcaatgttttttggaaacactgtttattttaaaataaaaatgtaaaaaaaaggtaaaaaaataaaattttaaatttt

SEQ ID NO: 425721 - DNA, 3378 bp, Homo sapiens
agcattcttcatccattatcagctggatggtagtgcccctctcgtgggagctgaacattatgaagtggccttcctgtcagtagagctcagaaccctcaaataccttctgttgggattgcgagtcgtatgttcagactataaaaagggcagagataagaaagaggatgtttcgaaaacaccaaagtaactaaccctttaggagtccttcaacctccccagttacccttggcgcgcagcatttgaagctgtctgtgaggccatcctgcgcttgtttccctcagacactttgtttttcatgttttggcagaatcttgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaaggctcactggatgtaaatgtaaaacttcgcgactttataaaactggcattcctaggggaggggctatttatcctacaggtccctgcctcctggcagtgccatggtatgtgtgcatggatataccagacacagtcaccatcggccatcagtagcagcccatgaacccacgtgcacatcctgcatcttgctcttctgacccttcattcccacttgtcttcaggcaggcatttctgggatctaaactagaaatccttgaaaacaaatagtaccagccactttgaggaatgtgcattcactgtagtgggttattatggggtctctgcctcctggctgtgttatgcggagcccaggagtggaggagagccgtggaaatagacagggagaggctggtacttgggttgtggtaatagtcaggcttgccacaagagggcactcatagatttgtttttatattcattcttgagaaaaaagcaactggttactgaacgtaactcatgacttatgtttcaaattttgcatagctgattttaagtcattttgatagctttgcaagaaaaatttttcctttgaaacaagggagtagggctgtttcattttctttccttctaatcctcatgccaagaggtgagaaacacttaaggtcatttaaggtgctagggaaagggttttcccatggagctttctgtgaggcgcagtaaaatagagccagcagcaaagtagaggaaaaagccagactgcgtcacacaagatttctcatccttttcaggagagagtcactgtgtagatttgaatcttttttctttgagtctgctttgaactttagcaggcttttcctaagactgacaattgtcgtcttaaatcagagatttgagggtagacttattttatggcaaatgtctatttttctgatataaaagtaacaatgctcattacagaagaatctaaacaaagaataaaaattagccatcttctctccatctaaaacagagctaaactttgctgatatgtttatgaatttcctttcagtattaaaaagtgcatataaggtgtatatttacacaaaattgaaggtcatacatagatacaggttggtatcctaactttaccctctcactgattaacatggtatcacgagtaacttcctatgtttttaaatctttgaaaatagatttctagtggttctaccttatccatccccacactgttgaaaattttggttgtttcagatacttttattatcaatgatgatgtgataaagtttcttgtatatatctctttggctctatctttggtaatttcttaagaatggaatcttagaattggactgtgaagagggggattcacattgctggggctaagtacaaattgacatcaccttttaggaatgaaatgcttctctttgaccctttagctccagtgtcccagcatagtcactgggcttcataggagtagcagtgagaggacagtgtcacagcaagggcctctctgcatgctccctgatcattgtgtttgcaggttcagcatttcttcttgagtccttcccttcttccaaccttattgcctcatttcccccttgtagtcaatgttttttggaaacactgtttattttaaaataaaaatgtaaaaaaaaggtaaaaaaataaaattttaaatttt

SEQ ID NO: 425722 - DNA, 2907 bp, Homo sapiens
ccgcccctcggcgtgaccccctcgcccccgtcgcacacggcggggcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagcagctgttttctctcctggattcgtatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcagggaggcccgaatctcctggagactattacttgacggtttc

SEQ ID NO: 425723 - DNA, 689 bp, Homo sapiens
ccgcccctcggcgtgaccccctcgcccccgtcgcacacggcggggcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagcagctgttttctctcctggattcgtgtgagccgccaccctcgctaccatccctgtcctcccagaccacaccctgctctgggccttgccgggagccacctctttggcttttcacatccctgggatggatcaaaactaagaaccttaatcattatttattacaaaattgacatctgctccttaaaatacaaacaaaccaatcccccgataagcttttgatatgattccaacattcaaactcctttatataccctctcctcaaaaacacaaaattgaaattatactttattttcttagttctgttccaaggatagaaggaattgaaaggttttgttaatcataggaattaggaagtgcgggttggggcgcagcggggaagatggattaaatttggtcaagttgagcttgttttaaaaatgtatttttaaaatattctag

SEQ ID NO: 425724 - DNA, 3270 bp, Homo sapiens
aatggtattcctatttcacagatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcaca

SEQ ID NO: 425725 - DNA, 4520 bp, Homo sapiens
agcgtgattgctgttgaagataactgtcagtctataccttgattctttgtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccagattccactgatctctgacttttctcttcaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaaggctcactggatgtaaatgtaaaacttcgcgactttataaaactggcattcctaggggaggggctatttatcctacaggtccctgcctcctggcagtgccatggtatgtgtgcatggatataccagacacagtcaccatcggccatcagtagcagcccatgaacccacgtgcacatcctgcatcttgctcttctgacccttcattcccacttgtcttcaggcaggcatttctgggatctaaactagaaatccttgaaaacaaatagtaccagccactttgaggaatgtgcattcactgtagtgggttattatggggtctctgcctcctggctgtgttatgcggagcccaggagtggaggagagccgtggaaatagacagggagaggctggtacttgggttgtggtaatagtcaggcttgccacaagagggcactcatagatttgtttttatattcattcttgagaaaaaagcaactggttactgaacgtaactcatgacttatgtttcaaattttgcatagctgattttaagtcattttgatagctttgcaagaaaaatttttcctttgaaacaagggagtagggctgtttcattttctttccttctaatcctcatgccaagaggtgagaaacacttaaggtcatttaaggtgctagggaaagggttttcccatggagctttctgtgaggcgcagtaaaatagagccagcagcaaagtagaggaaaaagccagactgcgtcacacaagatttctcatccttttcaggagagagtcactgtgtagatttgaatcttttttctttgagtctgctttgaactttagcaggcttttcctaagactgacaattgtcgtcttaaatcagagatttgagggtagacttattttatggcaaatgtctatttttctgatataaaagtaacaatgctcattacagaagaatctaaacaaagaataaaaattagccatcttctctccatctaaaacagagctaaactttgctgatatgtttatgaatttcctttcagtattaaaaagtgcatataaggtgtatatttacacaaaattgaaggtcatacatagatacaggttggtatcctaactttaccctctcactgattaacatggtatcacgagtaacttcctatgtttttaaatctttgaaaatagatttctagtggttctaccttatccatccccacactgttgaaaattttggttgtttcagatacttttattatcaatgatgatgtgataaagtttcttgtatatatctctttggctctatctttggtaatttcttaagaatggaatcttagaattggactgtgaagagggggattcacattgctggggctaagtacaaattgacatcaccttttaggaatgaaatgcttctctttgaccctttagctccagtgtcccagcatagtcactgggcttcataggagtagcagtgagaggacagtgtcacagcaagggcctctctgcatgctccctgatcattgtgtttgcaggttcagcatttcttcttgagtccttcccttcttccaaccttattgcctcatttcccccttgtagtcaatgttttttggaaacactgtttattttaaaataaaaatgtaaaaaaaaggtaaaaaaataaaattttaaatttt

SEQ ID NO: 425726 - DNA, 2966 bp, Homo sapiens
ccgcccctcggcgtgaccccctcgcccccgtcgcacacggcggggcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagcagctgttttctctcctggattcgtatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaaggctcactggatgtaaatgtaaaacttcgcgactttataaaactggcattcctaggggaggggctatttatcctacaggtccctgcctcctggcagtgccatggtatgtgtgcatggatataccagacacagtcaccatcggccatcagtagcagcccatgaacccacgtgcacatcctgcatcttgctcttctgacccttcattcccacttgtcttcaggcaggcatttctgggatctaaactagaaatccttgaaaacaaatagtaccagccactttgaggaatgtgcattcactgtagtgggttattatggggtctctgcctcctggctgtgttatgcggagcccaggagtggaggagagccgtggaaatagacagggagaggctggtacttgggttgtggtaatagtcaggcttgccacaagagggcactcatagatttgtttttatattcattcttgagaaaaaagcaactggttactgaacgtaactcatgacttatgtttcaaattttgcatagctgattttaagtcattttgatagctttgcaagaaaaatttttcctttgaaacaagggagtagggctgtttcattttctttccttctaatcctcatgccaagaggtgagaaacacttaaggtcatttaaggtgctagggaaagggttttcccatggagctttctgtgaggcgcagtaaaatagagccagcagcaaagtagaggaaaaagccagactgcgtcacacaagatttctcatccttttcaggagagagtcactgtgtagatttgaatcttttttctttgagtctgctttgaactttagcaggcttttcctaagactgacaattgtcgtcttaaatcagagatttgagggtagacttattttatggcaaatgtctatttttctgatataaaagtaacaatgctcattacagaagaatctaaacaaagaataaaaattagccatcttctctccatctaaaacagagctaaactttgctgatatgtttatgaatttcctttcagtattaaaaagtgcatataaggtgtatatttacacaaaattgaaggtcatacatagatacaggttggtatcctaactttaccctctcactgattaacatggtatcacgagtaacttcctatgtttttaaatctttgaaaatagatttctagtggttctaccttatccatccccacactgttgaaaattttggttgtttcagatacttttattatcaatgatgatgtgataaagtttcttgtatatatctctttggctctatctttggtaatttcttaagaatggaatcttagaattggactgtgaagagggggattcacattgctggggctaagtacaaattgacatcaccttttaggaatgaaatgcttctctttgaccctttagctccagtgtcccagcatagtcactgggcttcataggagtagcagtgagaggacagtgtcacagcaagggcctctctgcatgctccctgatcattgtgtttgcaggttcagcatttcttcttgagtccttcccttcttccaaccttattgcctcatttcccccttgtagtcaatgttttttggaaacactgtttattttaaaataaaaatgtaaaaaaaaggtaaaaaaataaaattttaaatttt

SEQ ID NO: 425727 - DNA, 1434 bp, Homo sapiens
ccgcccctcggcgtgaccccctcgcccccgtcgcacacggcggggcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagcagctgttttctctcctggattcgtatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccagatttatgctgccagggatgcccagatttcagtggcatcgataaacatcggtgtttatcgatgccactacaacctctgccacccgggttcaagtgattgtcttgcctcagcctccctagtaactgggaccacaggcgcccaccaccacgcccggctattttcttttttaaattttttatttttagtagagacggggttggtctcaactaaatgttgtccaggctggtctcaaactcctggcctcaagcgatccaccctcctaggcctcccaaagtgcctgggattacaggagtggcattccgataaaca

SEQ ID NO: 425728 - DNA, 612 bp, Homo sapiens
agtttctccacctgtcccgggttggtgctgggctggggggagccccggccaggcagccctgactgttggcctcctcacaggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgatctta

SEQ ID NO: 425729 - DNA, 2735 bp, Homo sapiens
  misc_feature (255)..(255): n is a, c, g, or t
  misc_feature (2455)..(2455): n is a, c, g, or t
cgaagaggcacaactcgaaccccagatccgggccgctctccctcctgccggctcctcggcgtatccatttccctactcatctccccaccctcaaccccccaaccgcgcgcacgcgcattgagtcagagccgcggcgtcctcccgcctcccgctccggaacccgcatgcgtgctgaagccgaccgcctccatccacgcacgctcagcccggcgagcgcattcagttctcgagctccagccctcagcgcatgcgcangacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggtaagagctctttgcagagggggtcaatttgaggcaccccaccctggtgtagagagaagggggcgtcccttagatcggcatgaccttgtgaagcccctcctctccagatcccaggttccttttctggaacagtgatgattgctactgtcttgtaagcatctcacccatgtggcaacatgctgtttcctgtgactttgaatcctcctaatcagccagcatcatgtaggtccttgtcaccagttttcctggtggggaaatttaggctcggggaaaagtgttacatagcaaggccacacatctgtggctaggagtcatttgattgctaggagtaggaccagtgaccagatttagcttaaggaagatttattccagggacctgatcacagaaagcagggccctgcagcagatgggaaccaggaagccatcagggtctcattcntcacacttctgcatttgtcttgtttcctgcctctggctttctctccctgctttcacttggcccggcactagctctgtggcccctactttacattacttctttgtccagagctctcagcatatgagtccaggtcttcctcatcttacttcaaagagaaaaattggaaagataaatagcttaactgggtgcagcctctctaacttggctccctacatctgtttgcagttggctgtgcctggaaggggtcaggagtgcagacaaagcagcaggaagcccctca

SEQ ID NO: 425730 - DNA, 2548 bp, Homo sapiens
  misc_feature (255)..(255): n is a, c, g, or t
cgaagaggcacaactcgaaccccagatccgggccgctctccctcctgccggctcctcggcgtatccatttccctactcatctccccaccctcaaccccccaaccgcgcgcacgcgcattgagtcagagccgcggcgtcctcccgcctcccgctccggaacccgcatgcgtgctgaagccgaccgcctccatccacgcacgctcagcccggcgagcgcattcagttctcgagctccagccctcagcgcatgcgcangacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgatctta

SEQ ID NO: 425731 - DNA, 2296 bp, Homo sapiens
tgcaggctggtacggtcgggagtatgggatagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgatctta

SEQ ID NO: 425732 - DNA, 2436 bp, Homo sapiens
caaataggctagtagaggccggtgttaatcggacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaagggggccgcgagcccgcgcgaggctagcgcaccggcggcgggcggggcgctccggcaggccccgcccccgccttggccattgaaaggtcgctgggacgtccggcgggggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgatctta

SEQ ID NO: 425733 - DNA, 1360 bp, Homo sapiens
  misc_feature (7)..(7): n is a, c, g, or t
  misc_feature (22)..(22): n is a, c, g, or t
  misc_feature (24)..(24): n is a, c, g, or t
ctcgtgnaatttcggcagcganancactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgatctta

SEQ ID NO: 425734 - DNA, 2038 bp, Homo sapiens
  misc_feature (255)..(255): n is a, c, g, or t
cgaagaggcacaactcgaaccccagatccgggccgctctccctcctgccggctcctcggcgtatccatttccctactcatctccccaccctcaaccccccaaccgcgcgcacgcgcattgagtcagagccgcggcgtcctcccgcctcccgctccggaacccgcatgcgtgctgaagccgaccgcctccatccacgcacgctcagcccggcgagcgcattcagttctcgagctccagccctcagcgcatgcgcangacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgatctta

SEQ ID NO: 425735 - DNA, 786 bp, Homo sapiens
ctcagccggggctgaactctcaggtgctccttgaagcccaggatgctgttaactgggagaaagaccctggcagtctatccctcttaccctccctgccccaactttccaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgatctta

SEQ ID NO: 425736 - DNA, 2324 bp, Homo sapiens
caaataggctagtagaggccggtgttaatcggacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgatctta

SEQ ID NO: 425737 - DNA, 2628 bp, Homo sapiens
  misc_feature (255)..(255): n is a, c, g, or t
cgaagaggcacaactcgaaccccagatccgggccgctctccctcctgccggctcctcggcgtatccatttccctactcatctccccaccctcaaccccccaaccgcgcgcacgcgcattgagtcagagccgcggcgtcctcccgcctcccgctccggaacccgcatgcgtgctgaagccgaccgcctccatccacgcacgctcagcccggcgagcgcattcagttctcgagctccagccctcagcgcatgcgcangacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcgggtgagcagagaaggagggaggagggggagccgttagggaagggattgcccccattgatgggattttttttacctccgtagtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgatctta

SEQ ID NO: 425738 - DNA, 2040 bp, Homo sapiens
atggctgcaattgatgaggaaggagggagagagataggagatgaagtcaatatattggtgaaggaacagacacagttaggggtcaagactctcatgaggttactcaaggaaccagagaaagaacgggactcagactcagatttctcccctcttcagcagactgagggatgccagcgaagagacaagcacttccgtcatgcagaaaacccccatcatcctctcaaaacctccagcagagcggcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggctgtgggacctggggtgcaagtgcaagagcaacagccactcaccccaaaccccaaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgatctta

SEQ ID NO: 425739 - DNA, 1495 bp, Homo sapiens
  misc_feature (255)..(255): n is a, c, g, or t
cgaagaggcacaactcgaaccccagatccgggccgctctccctcctgccggctcctcggcgtatccatttccctactcatctccccaccctcaaccccccaaccgcgcgcacgcgcattgagtcagagccgcggcgtcctcccgcctcccgctccggaacccgcatgcgtgctgaagccgaccgcctccatccacgcacgctcagcccggcgagcgcattcagttctcgagctccagccctcagcgcatgcgcangacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacaggtgccagccccgcctgcctttgccccaccctgccacatcctgcattgagcctcttcctggaatgtgattaagccagaaccctgcgtggattccatgtgcttccagtcaagccatggacatactggctgccctggggcaaattgtgtcttt

SEQ ID NO: 425740 - DNA, 835 bp, Homo sapiens
taaatttattgaattttacttctcccgctccaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtgttcggatcgtccccaatccgattctatttcggctgttattgagatctatccctatcttattatttaaacctcgcgcctcttg

SEQ ID NO: 425741 - DNA, 2060 bp, Homo sapiens
ctcgcgcactgtctctatgctccccagcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagatt

SEQ ID NO: 425742 - DNA, 2594 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcagggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagatt

SEQ ID NO: 425743 - DNA, 2353 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcagggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagatt

SEQ ID NO: 425744 - DNA, 2697 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcagggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggagcgaggtttcaccaggctggtctccaactcctgacctcaaatgatccacccatcttggcctcccagagtgctgagattacaggcgtgaggcaccactcctggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagatt

SEQ ID NO: 425745 - DNA, 1425 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcagggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagctctctgtttctacactttggagcatggatgtctgagaagccacaaagcctattgaacaatctctactaagtatataataaaacatgatatgtaaaac

SEQ ID NO: 425746 - DNA, 1499 bp, Homo sapiens
taaatttattgaattttacttctcccgctccaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagatt

SEQ ID NO: 425747 - DNA, 1319 bp, Homo sapiens
ctcgcgcactgtctctatgctccccagcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggactcaaaaggaaaactggaccaacaaaagat

SEQ ID NO: 425748 - DNA, 1379 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcagggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacaggtattctatgatattgaaaccacacttatcaattatggattgaatgatacaa

SEQ ID NO: 425749 - DNA, 1069 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcagggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagttttaattaaccttaaaaaaccttaaattacagctccaatttgctccttaggatttattccctctggacacccagggaaagatg

SEQ ID NO: 425750 - DNA, 1196 bp, Homo sapiens
gcgtgactccgccatcaggtccccggctccctccccggacctagcccactccgctgcgccagcgccgcgggcagtgagttcggggatcaggggaacccggggctccctcgcaccaaccccaaatcctgccctcctggcgatgaggcttttctagggcacctctacaatccgggtttgagggaggaggaggaaaggactgagggatcccctcatcgccagctgggagcgggctgggaggccgcagggagggcctgaaaaaggagacgggattgccacgaggttgggggcgcggggtggtagcggctttgagcgggtgagaaaagctcaggtggggcccgccgggccgaaggaggtaacccggcgcccggccctagccagccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcaggtgagcacgcaagtagcacaggctgcgctcaggacggctctgccacgtgctagtaggctccttttagggggttgttgagctgtgactccaaggcaaggtgcaacgctgggcgcaggatacccaaccgtgctttcgcagagctggtacaacagtgtgatgcaatgcctgctgttaccagaagagggatccaggccacacggaagggagtcgtgtcgtggtttaccccggggacaacagatgtggttaatgaaaccttgacagagaatgaaaaaa

SEQ ID NO: 425751 - DNA, 1904 bp, Homo sapiens
tataagggaagttgttcagtcaactcggaaaaagggtaacaacccggaaagtagactcaccgtcttggtctagagactgacccctgcacagacagaccccttcccctctctgcgaaaggaccaagccccagaagtcactccatctcctacggctcgcaatttccagaggccccctggcaccttccagcctgatgtcgtgcgtcaagttatggcccagcggtgcccccgcccccttggtgtccatcgaggaactggagaaccaggagctcgtcggcaaaggcgggttcggcacagtgttccgggcgcaacataggaagtggggctacgatgtggcggtcaagatcgtaaactcgaaggcgatatccagggaggtcaaggccatggcaagtctggataacgaattcgtgctgcgcctagaaggggttatcgagaaggtgaactgggaccaagatcccaagccggctctggtgactaaattcatggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaagctggcagattttggcctgtccacatttcagggaggctcacagtcagggacagggtccggggagccagggggcaccctgggctacttggccccagaactgtttgttaacgtaaaccggaaggcctccacagccagtgacgtctacagcttcgggatcctaatgtgggcagtgcttgctggaagagaagttgagttgccaaccgaaccatcactcgtgtacgaagcagtgtgcaacaggcagaaccggccttcattggctgagctgccccaagccgggcctgagactcccggcttagaaggactgaaggagctaatgcagctctgctggagcagtgagcccaaggacagaccctccttccaggaatgcctaccaaaaactgatgaagtcttccagatggtggagaacaatatgaatgctgctgtctccacggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataaagcaccttccaagcttgcctccaagagttacgagttaaggaagagtgccaccccttgaggcccctgacttccttctagggcagtctggcctgcccacaaactgactttgtgacctgtcccccaggagtcaataaacatgatggaatgctaaacagt

SEQ ID NO: 425752 - DNA, 2160 bp, Homo sapiens
tataagggaagttgttcagtcaactcggaaaaagggtaacaacccggaaagtagactcaccgtcttggtctagagactgacccctgcacagacagaccccttcccctctctgcgaaaggaccaagccccagaagtcactccatctcctacggctcgcaatttccagaggccccctggcaccttccagcctgatgtcgtgcgtcaagttatggcccagcggtgcccccgcccccttggtgtccatcgaggaactggagaaccaggagctcgtcggcaaaggcgggttcggcacagtgttccgggcgcaacataggaagtggggctacgatgtggcggtcaagatcgtaaactcgaaggcgatatccagggaggtcaaggccatggcaagtctggataacgaattcgtgctgcgcctagaaggggttatcgagaaggtgaactgggaccaagatcccaagccggctctggtgactaaattcatggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaagctggcagattttggcctgtccacatttcagggaggctcacagtcagggacagggtccggggagccagggggcaccctgggctacttggccccagaactgtttgttaacgtaaaccggaaggcctccacagccagtgacgtctacagcttcgggatcctaatgtgggcagtgcttgctggaagagaagttgagttgccaaccgaaccatcactcgtgtacgaagcagtgtgcaacaggcagaaccggccttcattggctgagctgccccaagccgggcctgagactcccggcttagaaggactgaaggagctaatgcagctctgctggagcagtgagcccaaggacagaccctccttccaggaatgcctaccaaaaactgatgaagtcttccagatggtggagaacaatatgaatgctgctgtctccacggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacaggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcaggtgagcacgcaagtagcacaggctgcgctcaggacggctctgccacgtgctagtaggctccttttagggggttgttgagctgtgactccaaggcaaggtgcaacgctgggcgcaggatacccaaccgtgctttcgcagagctggtacaacagtgtgatgcaatgcctgctgttaccagaagagggatccaggccacacggaagggagtcgtgtcgtggtttaccccggggacaacagatgtggttaatgaaaccttgacagagaatgaaaaaa

SEQ ID NO: 425753 - DNA, 2281 bp, Homo sapiens
tataagggaagttgttcagtcaactcggaaaaagggtaacaacccggaaagtagactcaccgtcttggtctagagactgacccctgcacagacagaccccttcccctctctgcgaaaggaccaagccccagaagtcactccatctcctacggctcgcaatttccagaggccccctggcaccttccagcctgatgtcgtgcgtcaagttatggcccagcggtgcccccgcccccttggtgtccatcgaggaactggagaaccaggagctcgtcggcaaaggcgggttcggcacagtgttccgggcgcaacataggaagtggggctacgatgtggcggtcaagatcgtaaactcgtgagtgaccccggttgaccccagccgcaatctggccaaaaaggaaggcgatatccagggaggtcaaggccatggcaagtctggataacgaattcgtgctgcgcctagaaggggttatcgagaaggtgaactgggaccaagatcccaagccggctctggtgactaaattcatggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaagctggcagattttggcctgtccacatttcagggaggctcacagtcagggacagggtccggggagccagggggcaccctgggctacttggccccagaactgtttgttaacgtaaaccggaaggcctccacagccagtgacgtctacaggtaaggatcccggcccaaacacacagccaggattcctacacttctctgggccctcccaggggatgatgtataggaaaggagtcttgccagtgattggaccgatcctcagctttgtgtctcctgcagcttcgggatcctaatgtgggcagtgcttgctggaagagaagttgagtgtaagactctaggaggattctgggatccttaaccccaggtgcccttctcttgaaagccccaaggcttccccttcccgctcacctacttagactgccctcctccctcctcgtgcccccacattacactccctgcctctttccatgatgaagcagataattcccttttaccctgaatgccttctcttctcaccctcctcccctactccagtgccaaccgaaccatcactcgtgtacgaagcagtgtgcaacaggcagaaccggccttcattggctgagctgccccaagccgggcctgagactcccggcttagaaggactgaaggagctaatgcagctctgctggagcagtgagcccaaggacagaccctccttccaggaatgcctaccaaaaactgatgaagtcttccagatggtggagaacaatatgaatgctgctgtctccacggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataaagcaccttccaagcttgcctccaagagttacgagttaaggaagagtgccaccccttgaggcccctgacttccttctagggcagtctggcctgcccacaaactgactttgtgacctgtcccccaggagtcaataaacatgatggaatgctaaacagt

SEQ ID NO: 425754 - DNA, 931 bp, Homo sapiens
accgtccccagcccacccctgagttcccagacaacagattatggaccgagagactactcccttgggtttactctggctcatccaagtcatacccagcaaactcctcccatccctgcaggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataaagcaccttccaagcttgcctccaagagttacgagttaaggaagagtgccaccccttgaggcccctgacttccttctagggcagtctggcctgcccacaaactgactttgtgacctgtcccccaggagtcaataaacatgatggaatgctaaacagt

SEQ ID NO: 425755 - DNA, 858 bp, Homo sapiens
accgtccccagcccacccctgagttcccagacaacagattatggaccgagagactactcccttgggtttactctggctcatccaagtcatacccagcaaactcctcccatccctgcaggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacggggctgagagacaaggcatgaactggtcctgcaggaccccggagccaaatccagtaacagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataaagcaccttccaagcttgcctccaagagttacgagttaaggaagagtgccaccccttgaggcccctgacttccttctagggcagtctggcctgcccacaaactgactttgtgacctgtcccccaggagtcaataaacatgatggaatgctaaacagt

SEQ ID NO: 425756 - DNA, 538 bp, Homo sapiens
aaaagctcaggtggggcccgccgggccgaaggaggtaacccggcgcccggccctagccagccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggtgagccgagcctctgctgcgggagggtctctacctggggagcattttcggggttggggtttgtggggtcttcttttcgatgtgttttcgttgctgggagcagagaaagaaaggaccattgagcctggctaggaactgcagtgaccctgggcaagtcactctacccttctgggtctgctcagggagaaagctgagtcctggatgcttctcgtttctgtccgggttctgacagactttatgaacatccgtggtctacgggttctacaataaatccatcaccggattttccagtt

SEQ ID NO: 425757 - DNA, 1062 bp, Homo sapiens
tataagggaagttgttcagtcaactcggaaaaagggtaacaacccggaaagtagactcaccgtcttggtctagagactgacccctgcacagacagaccccttcccctctctgcgaaaggaccaagccccagaagtcactccatctcctacggctcgcaatttccagaggccccctggcaccttccagcctgatgtcgtgcgtcaagttatggcccagcggtgcccccgcccccttggtgtccatcgaggaactggagaaccaggagctcgtcggcaaaggcgggttcggcacagtgttccgggcgcaacataggaagtggggctacgatgtggcggtcaagatcgtaaactcgaaggcgatatccagggaggtcaaggccatggcaagtctggataacgaattcgtgctgcgcctagaaggggttatcgagaaggtgaactgggaccaagatcccaagccggctctggtgactaaattcatggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaaggtcagctggtctacacccctctcagcctcaagacaaggccccagagctgctccagccaggcccgccggacactagacctccagagccctgtctattgaataggcgtagcctctctctctggacacagggctgccaggggacaaagcccagccaggagttttagctcctgcctaccaggtgatagaggccctgagccacacgagtcatttccaccagctgccccaccagcccctccaaagagtcatggctgacccagccctggagactcagaccttgacctagccctaccacaaggcacctagatctaccatccaagggaacctcttcccttgacctccacactccctttacaaagctgaacctgcaccttctgggggcaggggggttcctggaggctctc

SEQ ID NO: 425758 - DNA, 1744 bp, Homo sapiens
  misc_feature (4)..(4): n is a, c, g, or t
tgancgactctagttgatcccccctaggtatatgtcgtgcgtcaagttatggcccagcggtgcccccgcccccttggtgtccatcgaggaactggagaaccaggagctcgtcggcaaaggcgggttcggcacagtgttccgggcgcaacataggaagtggggctacgatgtggcggtcaagatcgtaaactcgaaggcgatatccagggaggtcaaggccatggcaagtctggataacgaattcgtgctgcgcctagaaggggttatcgagaaggtgaactgggaccaagatcccaagccggctctggtgactaaattcatggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaagctggcagattttggcctgtccacatttcagggaggctcacagtcagggacagggtccggggagccagggggcaccctgggctacttggccccagaactgtttgttaacgtaaaccggaaggcctccacagccagtgacgtctacagcttcgggatcctaatgtgggcagtgcttgctggaagagaagttgagttgccaaccgaaccatcactcgtgtacgaagcagtgtgcaacaggcagaaccggccttcattggctgagctgccccaagccgggcctgagactcccggcttagaaggactgaaggagctaatgcagctctgctggagcagtgagcccaaggacagaccctccttccaggaatgcctaccaaaaactgatgaagtcttccagatggtggagaacaatatgaatgctgctgtctccacggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataaagcaccttccaagcttgcctccaagagttacgagttaaggaagagtgccaccccttgaggcccctgacttccttctagggcagtctggcctgcccacaaactgactttgtgacctgtcccccaggagtcaataaacatgatggaatgctaaacagt

SEQ ID NO: 425759 - DNA, 2210 bp, Homo sapiens
  misc_feature (4)..(4): n is a, c, g, or t
tgancgactctagttgatcccccctaggtatatgtcgtgcgtcaagttatggcccagcggtgcccccgcccccttggtgtccatcgaggaactggagaaccaggagctcgtcggcaaaggcgggttcggcacagtgttccgggcgcaacataggaagtggggctacgatgtggcggtcaagatcgtaaactcgtgagtgaccccggttgaccccagccgcaatctggccaaaaaggtggagccactgtgctctggggcctgaatggcgaagggagggattttcccacgaccccggtgcgactccagctctctcctggagtgtaggaaggcgatatccagggaggtcaaggccatggcaagtctggataacgaattcgtgctgcgcctagaaggggttatcgagaaggtgaactgggaccaagatcccaagccggctctggtgactaaattcatggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaagctggcagattttggcctgtccacatttcagggaggctcacagtcagggacagggtccggggagccagggggcaccctgggctacttggccccagaactgtttgttaacgtaaaccggaaggcctccacagccagtgacgtctacaggtaaggatcccggcccaaacacacagccaggattcctacacttctctgggccctcccaggggatgatgtataggaaaggagtcttgccagtgattggaccgatcctcagctttgtgtctcctgcagcttcgggatcctaatgtgggcagtgcttgctggaagagaagttgagtgtaagactctaggaggattctgggatccttaaccccaggtgcccttctcttgaaagccccaaggcttccccttcccgctcacctacttagactgccctcctccctcctcgtgcccccacattacactccctgcctctttccatgatgaagcagataattcccttttaccctgaatgccttctcttctcaccctcctcccctactccagtgccaaccgaaccatcactcgtgtacgaagcagtgtgcaacaggcagaaccggccttcattggctgagctgccccaagccgggcctgagactcccggcttagaaggactgaaggagctaatgcagctctgctggagcagtgagcccaaggacagaccctccttccaggaatgcctaccaaaaactgatgaagtcttccagatggtggagaacaatatgaatgctgctgtctccacggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataaagcaccttccaagcttgcctccaagagttacgagttaaggaagagtgccaccccttgaggcccctgacttccttctagggcagtctggcctgcccacaaactgactttgtgacctgtcccccaggagtcaataaacatgatggaatgctaaacagt

SEQ ID NO: 425760 - DNA, 1717 bp, Homo sapiens
tataagggaagttgttcagtcaactcggaaaaagggtaacaacccggaaagtagactcaccgtcttggtctagagactgacccctgcacagacagaccccttcccctctctgcgaaaggaccaagccccagaagtcactccatctcctacggctcgcaatttccagaggccccctggcaccttccagcctgatgtcgtgcgtcaagttatggcaccctgggctacttggccccagaactgtttgttaacgtaaaccggaaggcctccacagccagtgacgtctacaggtaaggatcccggcccaaacacacagccaggattcctacacttctctgggccctcccaggggatgatgtataggaaaggagtcttgccagtgattggaccgatcctcagctttgtgtctcctgcagcttcgggatcctaatgtgggcagtgcttgctggaagagaagttgagtgtaagactctaggaggattctgggatccttaaccccaggtgcccttctcttgaaagccccaaggcttccccttcccgctcacctacttagactgccctcctccctcctcgtgcccccacattacactccctgcctctttccatgatgaagcagataattcccttttaccctgaatgccttctcttctcaccctcctcccctactccagtgccaaccgaaccatcactcgtgtacgaagcagtgtgcaacaggcagaaccggccttcattggctgagctgccccaagccgggcctgagactcccggcttagaaggactgaaggagctaatgcagctctgctggagcagtgagcccaaggacagaccctccttccaggaatgcctaccaaaaactgatgaagtcttccagatggtggagaacaatatgaatgctgctgtctccacggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataaagcaccttccaagcttgcctccaagagttacgagttaaggaagagtgccaccccttgaggcccctgacttccttctagggcagtctggcctgcccacaaactgactttgtgacctgtcccccaggagtcaataaacatgatggaatgctaaacagt

SEQ ID NO: 425761 - DNA, 471 bp, Homo sapiens
tgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcagagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccaggagtttgctgtggacaagggcacagaagttatcatcaatctgtgggcgctgcatcacaatgagaaggagtggcaccagccggatcagttcatgcctgagcgtttcttgaatccagcggggacccagctcatctca

SEQ ID NO: 425762 - DNA, 365 bp, Homo sapiens
tgggcttacacacactagtcacctccaacctactctggtcttcaggtgaagaggcggaagaatgagggggcatgaggctgaagcaaggaagggagtacgaagtcccagacccacttttcctcttccactctggagcagcatcggtcgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggaggga

SEQ ID NO: 425763 - DNA, 280 bp, Homo sapiens
tgggcttacacacactagtcacctccaacctactctggtcttcaggtgaagaggcggaagaatgagggggcatgaggctgaagcaaggaagggagtacgaagtcccagacccacttttcctcttccactctggagcagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctca

SEQ ID NO: 425764 - DNA, 1768 bp, Homo sapiens
ggggaataatcgagttgtaactcattgtgtagaatatcgatatgtaaacacgtggagattccaggaacaccgccagggatctgcagagcggcctctgaagtttcacgggcttttccattgactccagccactgcttcttcagtggctcttcctccctttcactgtgaccagatgccttttctcttcattctttacttatgaattggacagtaagtctgaattaatttcacaagattcatagcttcttttatgctgcagaaaagcccagggcaaagaataagaagaaagacattcatgtgtttattcattcaacaaacatctttgccggcatagcgtgggaggaggtcaccagacccttctcctgggagtttccctcccttctgagtgccacagatcctccctgaaatgtgtggccgtagagccgccgttgcctccatgacttagcagttctctgcttcctttgcaggggccctggcctccagtctgagtgctgacctcgaagagcccctgagtgaggaggagacagaacaccctctcctgcctctgccccgagccactaaacccagaatctccaggaaatttcgttgctgtactagtgccctcagcaggtcttcccattagtggacttctgaagcccatggtgaatcccactaccgtgtctcagatgggactcaaactaggctgtatcatcttgtcctgaaacctcacaaaccttggacttccaaagaagaaaagaaaaagtcaccaaaaaccagagatgaacccactgacacgtgggcactggtgtggctgctctgggcagatgacagcaggaaaagattctgcgctttcagggagggggcagagggcagcttgcttctgcaccccaagttgtttcttctcatttatgaacccaagcatgattcacaaaggggctggcaaaacaattgtctaattgaggaatctgatctgcattgattttgctagttccttttatgttaggatttatggtttactcaaaaatttcatcatcatggaaattggctttccccggggtcttttgcccaggagaagttttacctcagttgtccagtgttttcccacatggtacctgacgcccgctaactaagcagaggctctcctcaccacgcagaggcgcttcaggtcatgacagtgatgcccctatcttagaacactcagaagattccagaaatacagggtcctgtccttgcataagttcctgcaggacaggaagtgtcccaaggctcaaaacaacacagaccacatccacacaaaaggcgcatgccggcttcaggcgctaggctgagacgggtaccccccgaatggccttgtgcctccaaaagcctcacgctgcaactttgctgctcctgtctgttgcccagagaggcctcacacaggcctcagaaatgtttcttgtcacacaaagcttttggtagccgattccaagcgagggatttaatccttacatttttgcccatttggctccaaggaaggcttattagacctgtttttttgttgttgttgtttttttttcttaaaaacaaaatgaatgaatgaatgaaaagagaagcaatggtgagccctctcctgctggggcgccctgggtgggccttgccggtcctgcagcagagaaatcagtcagcagcgaagagctgttggcgaaggccccaggctgtgtcctggacccttgacctgcctcagagctagaggtttgctccaccccgcacttcacttgggaagtaaatccaagaagcttaccagagtccat

SEQ ID NO: 425765 - DNA, 5935 bp, Homo sapiens
agtatgcctaaaatcatccagactgttggtggtggtgctgtgcaggagagagcgcctgagctggatggtggtgggcccacggagcaggacaaaagccattctaacagcagcaccttgtcggaccgaagactcagcaactccagcctctgtagcattgaagaagagcaccgaatggtgtatgaaatggtacagcggattctcttgtcaacacgaggttatgtcaacttcgtgaatgaagtatttcaccaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggcctcatctgaaagttctggtcataaacgatcttccagttggggacgcacatactccttcacaagtgcaatgagcagagggtgtgtgacagaggaggaaaatacaaatgtgaaagccggcgtccaggctttgttgcaggtatttttgacgaactctgcaaacatctttttgttggaaccatgtgctgaagttcctgtgctcttgaaagaacaagttgatgcttgtaaagctgttttgattatttttaggcgcatgataatggagcttacaatgaataaaaagacatgggaacagatgttgcaaatactactcaggataacagaagctgtcatgcagaagccaaaggataaacgaataaaggacttgtttgcccagagcttggcagggttactatttaggacgctcatggtagcttggatccgagcaaacctctgtgtgtacatttctcgagagctctgggatgactttcttggtgtgctgtcctccctcacggaatgggaggaacttataaacgagtgggccaacattatggactccttgacagcagtgcttgcaagaaccgtttatggagttgagatgacaaacctacctctggataaattaagtgaacaaaaggaaaagaagcaacgaggcaaaggctgtgttctagatcctcagaaaggaaccaccgtggggaggtccttttctctcagctggcggagccacccagatgtgaccgaaccgatgcgatttaggagtgccaccacgtctggagcaccgggagtggaaaaggcaagaaatattgttcgccaaaaagcaactgaagtggaggagtgtcaacagtcagaaaatgcacctgcagccggatctggccatctcacagtgggacagcagcagcaggtccttcggagcagcagcacctccgacatccccgagccgctgtgctcagattcttctcagggtcaaaaggcagaaaacacacagaattcgagttcttcagagcctcagcctattcaagagaataaaggacatgtgaagagagaacatgaaggaataacaatcttagttcgaagaagcagcagccctgctgaattggatttgaaagatgatttgcagcagacacaaggaaaatgtagggaaagacagaagagtgaaagtaccaacagtgacacaactctgggctgtaccaatgaggcagagctgtccatgggcccatggcagacctgtgaggaagacccagaactgaatactcccacagatgttgtggctgatgctgatgcccgtcattggttacaactgagtcccaccgatgcttcaaatttaacagatagcagcgagtgcctcacagatgactgtagtataatcgccggggggagcctcactggttggcacccagactctgctgctgtgttatggcgaagggtcttggggatcctcggagatgtgaataacatccagtcacccaagatccatgccagagttttctgctatctctatgaactctggtacaaactagcaaagatacgggataatctagcaataagcctggataaccagtcttctccatctcctccagttttgatcccaccactcagaatgtttgcatcatggctgtttaaggcggcgacactgccaaatgaatataaggaaggcaaactacaagcctacaggctgatctgtgccatgatgaccagacgccaggacgttctgccaaactcagatttcctggtgcatttttaccttgtgatgcacctgggattaaccagcgaggatcaggatatcttaaatacgatcataaggcactgtccaccccgctttttctccctgggttttcctggcttctcaatgctggtgggggacttcatcacggccgctgccagggtccttagcacagacattttgacggcgcctcgttcagaggctgtcactgtcctcggctctctggtctgctttccaaatacctaccaggagattcctttactgcagtcagtgccagaagtaaatgaggccattacaggaactgaagatgtcaagcattacctcataaatattttactgaagaatgccacagaagaaccaaatgaatatgcaagatgcattgctgtttgctcccttggggtctggatatgtgaagagcttgcacagtgtacaagccaccctcaggtgaaagaggccatcaatgtgataggagtaactctgaagtttcccaacaaaatcgtggcccaggtagcttgcgatgtccttcagttgctggtttcctactgggagaagcttcagatgtttgaaacctctctgcctcggaaaatggcagaaatcctcgtggccacagttgcttttcttttaccaagtgcagagtactcctcagtggaaacagacaagaagtttattgtgtccttgctactctgcctcttggactggtgcatggcattgcccgtgagtgtccttctccaccccgtgtccacagcagtcctagaggagcagcattcggccagagcccccttgctggattatatctacagggttttgcactgctgtgtgtgtggctcaagcacgtacacccaacagagtcactacatactgaccctggctgacttgtcatccacggattatgaccccttcctgccactggcaaatgtgaagagctctgagccagtccagtatcattcatcagcagaattgggtaacctgctgactgttgaagaggagaagaagagaagaagtttggagttgatccctttgactgctcgaatggtgatggcccacctggtgaaccacctggggcactaccccctcagtgggggccctgccatactgcacagccttgtcagcgagaaccatgacaatgcccatgtggaaggctccgagctgtcctttgaggtgttcagaagtccaaacctgcagctgtttgtatttaatgatagcaccctcatctcctaccttcagacacccacagaaggaccggtagggggatcaccagtgggctctctctctgatgtgagagtaattgtgagggatatctcagggaagtactcttgggatggtaaggttttatatggacctttggaaggctgcttagcacccaatggaagaaatccttcatttctgatttcgagctggcatcgtgacacatttggacctcagaaagactcttctcaagttgaggagggggatgatgttcttgacaaattacttgaaaacattggccatacaagtcctgaatgccttttaccgtcacagctaaatctaaatgaaccttccctaaccccatgtggcatgaactatgaccaagagaaggaaatcattgaggtcattttgcgccaaaatgctcaagaggatgagtatatccagagtcataacttcgattctgcaatgaaagtcaccagccaagggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttctatgaagagcgagctctgtatctcgaagcaataattcagaaccaccgcgaagtaatgacattcgaggatttcgcagcccaagtcttttctccctctcccagctactccctcagcggaacgggggccctggcctccagtctgagtgctgacctcgaagagcccctgagtgaggaggagacagaacaccctctcctgcctctgccccgagccactaaacccagaatctccaggaaatttcgttgctgtactagtgccctcagcaggtcttcccattagtggacttctgaagcccatggtgaatcccactaccgtgtctcagatgggactcaaactaggctgtatcatcttgtcctgaaacctcacaaaccttggacttccaaagaagaaaagaaaaagtcaccaaaaaccagagatgaacccactgacacgtgggcactggtgtggctgctctgggcagatgacagcaggaaaagattctgcgctttcagggagggggcagagggcagcttgcttctgcaccccaagttgtttcttctcatttatgaacccaagcatgattcacaaaggggctggcaaaacaattgtctaattgaggaatctgatctgcattgattttgctagttccttttatgttaggatttatggtttactcaaaaatttcatcatcatggaaattggctttccccggggtcttttgcccaggagaagttttacctcagttgtccagtgttttcccacatggtacctgacgcccgctaactaagcagaggctctcctcaccacgcagaggcgcttcaggtcatgacagtgatgcccctatcttagaacactcagaagattccagaaatacagggtcctgtccttgcataagttcctgcaggacaggaagtgtcccaaggctcaaaacaacacagaccacatccacacaaaaggcgcatgccggcttcaggcgctaggctgagacgggtaccccccgaatggccttgtgcctccaaaagcctcacgctgcaactttgctgctcctgtctgttgcccagagaggcctcacacaggcctcagaaatgtttcttgtcacacaaagcttttggtagccgattccaagcgagggatttaatccttacatttttgcccatttggctccaaggaaggcttattagacctgtttttttgttgttgttgtttttttttcttaaaaacaaaatgaatgaatgaatgaaaagagaagcaatggtgagccctctcctgctggggcgccctgggtgggccttgccggtcctgcagcagagaaatcagtcagcagcgaagagctgttggcgaaggccccaggctgtgtcctggacccttgacctgcctcagagctagaggtttgctccaccccgcacttcacttgggaagtaaatccaagaagcttaccagagtccat

SEQ ID NO: 425766 - DNA, 1607 bp, Homo sapiens
tgacatcagtcagctactctcatatctttgatttgacttttatcagtttttaaaatttgtttttccatttcaaatcaacaggttccattttttgggcctctgtttgatggagccatagtgagtgggaagctgctgccaagccttgtatgtgccacgtgcatcaacgccagcagggctgtgaagtgcctcatcccactctaccagagcttgtatctttttgctttaaatgtgtaacttactaaccatcccagaatcaagattcctggcagtttttcataagaggtaagtattcaaaactgaattgaagagggaagagaatttttttcaacctctgttaaaaataacatagtggtttttcatagcatttgttaatttatattaaatataataattttatgctgcattaaacttagagtttactttcataatttactcacatacgtttgtgtctgagaagctgtgaccattatgagatgctcatatcttcttaggtattttgccccacgttcagtctcatcctgtatccctcttatttgtggcagtccattgtatataaggtgggatgctgagcaaaacgtatcgctcattcagagtgcctaccagaaaccaaagcaaatgaaatgaccctaataaatcaaagaatgtggcaggtaccacctgagaagtgcaagtaggtttctggaagatcagaggagatagaaattgcatttggttgagggtagagggaaagatgtcctgaattaagttgcatttggacttatcaataggaatagctagaaattcttttgtaattttcccaaatcattgatattttctctagttcctgattttgtttccaaaaacagaataaatttcactcctaaaattttttcctcaaacattaattggcctgctgtagtccttaaattcaagcatgatctcaagttataagaaaaagagattaagatgggtgaccttataaaattgatgcaaaaaaagtgacctcctaataaaacttagaatctctttgtttctaattggtattgataataatttgaaacatattgtgtttgacctctatatatacttctcccaacctgatagtaagtgatgtgttgctatagcaagtgagagttgggggtagatgaaaactatcccatgtgaatagatacggttcatgaaaaaatacctttcattaaaatcctggtcacttcattgactgatattctgcctttagattaaaaaaaaatacatatgccatgtggcaacttaaaattatcatagaaatgagtagtagaaaagagctattaggtcccatctggtccctcccctgggggccagggcaggattattcccttcagtgtactctctcgtgctttgtccaggctggtggtgagtgttttggagatggcattctttgcagtgatttccacaacactgtagacgtaatcttgtggctggtgtcaatttggccttcagcatggagtttttatttcacatactattaaaaagagcctcttggcagaaatgagaaagaactattcagcgattagtttgtcagtttgcatgtcaactaggacgagctgggcacgcatcagtcaagtatgttggaccaaggcagcaaaaaa

SEQ ID NO: 425767 - DNA, 395 bp, Homo sapiens
gaaaggaagcaaaaataaaatttgcctaatagcaaagaagatatttaaagagtggtcattccatttccagctaggaccaagcaggagtcctagctgccaagtgctgcagtagtttgacagattgtcaggggacacgcggtgagtagcatccgtggtgcacatggcctctgttttcacaggttttgcactgctgtgtgtgtggctcaagcacgtacacccaacagagtcactacatactgaccctggctgacttgtcatccacggattatgaccccttcctgccactggcaaatgtgaagagctctgagccagtccagtatcattcatcagcagaattgggtaacctgctgactgttgaagagggtgagtattctttcaggtattgaagagctctc

SEQ ID NO: 425768 - DNA, 5354 bp, Homo sapiens
agtatgcctaaaatcatccagactgttggtggtggtgctgtgcaggagagagcgcctgagctggatggtggtgggcccacggagcaggacaaaagccattctaacagcagcaccttgtcggaccgaagactcagcaactccagcctctgtagcattgaagaagagcaccgaatggtgtatgaaatggtacagcggattctcttgtcaacacgaggttatgtcaacttcgtgaatgaagtatttcaccaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggcctcatctgaaagttctggtcataaacgatcttccagttggggacgcacatactccttcacaagtgcaatgagcagagggtgtgtgacagaggaggaaaatacaaatgtgaaagccggcgtccaggctttgttgcaggtatttttgacgaactctgcaaacatctttttgttggaaccatgtgctgaagttcctgtgctcttgaaagaacaagttgatgcttgtaaagctgttttgattatttttaggcgcatgataatggagcttacaatgaataaaaagacatgggaacagatgttgcaaatactactcaggataacagaagctgtcatgcagaagccaaaggataaacgaataaaggacttgtttgcccagagcttggcagggttactatttaggacgctcatggtagcttggatccgagcaaacctctgtgtgtacatttctcgagagctctgggatgactttcttggtgtgctgtcctccctcacggaatgggaggaacttataaacgagtgggccaacattatggactccttgacagcagtgcttgcaagaaccgtttatggagttgagatgacaaacctacctctggataaattaagtgaacaaaaggaaaagaagcaacgaggcaaaggctgtgttctagatcctcagaaaggaaccaccgtggggaggtccttttctctcagctggcggagccacccagatgtgaccgaaccgatgcgatttaggagtgccaccacgtctggagcaccgggagtggaaaaggcaagaaatattgttcgccaaaaagcaactgaagtggaggagtgtcaacagtcagaaaatgcacctgcagccggatctggccatctcacagtgggacagcagcagcaggtccttcggagcagcagcacctccgacatccccgagccgctgtgctcagattcttctcagggtcaaaaggcagaaaacacacagaattcgagttcttcagagcctcagcctattcaagagaataaaggacatgtgaagagagaacatgaaggaataacaatcttagttcgaagaagcagcagccctgctgaattggatttgaaagatgatttgcagcagacacaaggaaaatgtagggaaagacagaagagtgaaagtaccaacagtgacacaactctgggctgtaccaatgaggcagagctgtccatgggcccatggcagacctgtgaggaagacccagaactgaatactcccacagatgttgtggctgatgctgatgcccgtcattggttacaactgagtcccaccgatgcttcaaatttaacagatagcagcgagtgcctcacagatgactgtagtataatcgccggggggagcctcactggttggcacccagactctgctgctgtgttatggcgaagggtcttggggatcctcggagatgtgaataacatccagtcacccaagatccatgccagagttttctgctatctctatgaactctggtacaaactagcaaagatacgggataatctagcaataagcctggataaccagtcttctccatctcctccagttttgatcccaccactcagaatgtttgcatcatggctgtttaaggcggcgacactgccaaatgaatataaggaaggcaaactacaagcctacaggctgatctgtgccatgatgaccagacgccaggacgttctgccaaactcagatttcctggtgcatttttaccttgtgatgcacctgggattaaccagcgaggatcaggatatcttaaatacgatcataaggcactgtccaccccgctttttctccctgggttttcctggcttctcaatgctggtgggggacttcatcacggccgctgccagggtccttagcacagacattttgacggcgcctcgttcagaggctgtcactgtcctcggctctctggtctgctttccaaatacctaccaggagattcctttactgcagtcagtgccagaagtaaatgaggccattacaggaactgaagatgtcaagcattacctcataaatattttactgaagaatgccacagaagaaccaaatgaatatgcaagatgcattgctgtttgctcccttggggtctggatatgtgaagagcttgcacagtgtacaagccaccctcaggtgaaagaggccatcaatgtgataggagtaactctgaagtttcccaacaaaatcgtggcccaggtagcttgcgatgtccttcagttgctggtttcctactgggagaagcttcagatgtttgaaacctctctgcctcggaaaatggcagaaatcctcgtggccacagttgcttttcttttaccaagtgcagagtactcctcagtggaaacagacaagaagtttattgtgtccttgctactctgcctcttggactggtgcatggcattgcccgtgagtgtccttctccaccccgtgtccacagcagtcctagaggagcagcattcggccagagcccccttgctggattatatctacagggttttgcactgctgtgtgtgtggctcaagcacgtacacccaacagagtcactacatactgaccctggctgacttgtcatccacggattatgaccccttcctgccactggcaaatgtgaagagctctgagccagtccagtatcattcatcagcagaattgggtaacctgctgactgttgaagaggagaagaagagaagaagtttggagttgatccctttgactgctcgaatggtgatggcccacctggtgaaccacctggggcactaccccctcagtgggggccctgccatactgcacagccttgtcagcgagaaccatgacaatgcccatgtggaaggctccgagctgtcctttgaggtgttcagaagtccaaacctgcagctgtttgtatttaatgatagcaccctcatctcctaccttcagacacccacagaaggaccggtagggggatcaccagtgggctctctctctgatgtgagagtaattgtgagggatatctcagggaagtactcttgggatggtaaggttttatatggacctttggaaggctgcttagcacccaatggaagaaatccttcatttctgatttcgagctggcatcgtgacacatttggacctcagaaagactcttctcaagttgaggagggggatgatgttcttgacaaattacttgaaaacattggccatacaagtcctgaatgccttttaccgtcacagctaaatctaaatgaaccttccctaaccccatgtggcatgaactatgaccaagagaaggaaatcattgaggtcattttgcgccaaaatgctcaagaggatgagtatatccagagtcataacttcgattctgcaatgaaagtcaccagccaagggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttacgcgtccggtgatgaggaggtgtatagagggctgaccctccaggaggctgttgccacagtccaggtgtggtatgtaccaaatacctggatgtggaggaggagagacatgggtggatgcttttccacaccaataagtaaaacaactgaccaatctccaagcaaaaaaaaagtgatcatccatcagtattattttctaattgccatcaaatgtctatgaccctcagaaagcatgatggttaacaatacagactttggagtgagattggctatgtccagatcctagcttttgtatttactagttgcatgaacttgtgcagtctggccttcagtgcatatacctgtaacataagctgcatagacatgtctgttttatagggttagtgaaattatccaaatggcgattatccaaatcacgatggtgatttatggaaagacatcacaggcaaagtatacaagtttctttaaagaagttaacaagaactgaactgggtagaaatggttgtacaaagccagaagctttccacattattcctattagaggagcaaatatcccatgccattcaagtatgtcaaatgtgccctagcatttattggaccattaggtttttcttggtgtttctttatcattcttctgtgatgtcttaaacccttttggtttgttttaatatttatgtatttcttaagaggtacatgtaactggtaggcgcactgccaacacattactgaatttttctcaaggttaccataccaagtgtactatcctttagcaggccaaatattaggttttcttgaagtttattcctgcaagtttgtgcaacaatttaatgacacattttaaattt

SEQ ID NO: 425769 - DNA, 5975 bp, Homo sapiens
agtatgcctaaaatcatccagactgttggtggtggtgctgtgcaggagagagcgcctgagctggatggtggtgggcccacggagcaggacaaaagccattctaacagcagcaccttgtcggaccgaagactcagcaactccagcctctgtagcattgaagaagagcaccgaatggtgtatgaaatggtacagcggattctcttgtcaacacgaggttatgtcaacttcgtgaatgaagtatttcaccaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggcctcatctgaaagttctggtcataaacgatcttccagttggggacgcacatactccttcacaagtgcaatgagcagagggtgtgtgacagaggaggaaaatacaaatgtgaaagccggcgtccaggctttgttgcaggtatttttgacgaactctgcaaacatctttttgttggaaccatgtgctgaagttcctgtgctcttgaaagaacaagttgatgcttgtaaagctgttttgattatttttaggcgcatgataatggagcttacaatgaataaaaagacatgggaacagatgttgcaaatactactcaggataacagaagctgtcatgcagaagccaaaggataaacgaataaaggacttgtttgcccagagcttggcagggttactatttaggacgctcatggtagcttggatccgagcaaacctctgtgtgtacatttctcgagagctctgggatgactttcttggtgtgctgtcctccctcacggaatgggaggaacttataaacgagtgggccaacattatggactccttgacagcagtgcttgcaagaaccgtttatggagttgagatgacaaacctacctctggataaattaagtgaacaaaaggaaaagaagcaacgaggcaaaggctgtgttctagatcctcagaaaggaaccaccgtggggaggtccttttctctcagctggcggagccacccagatgtgaccgaaccgatgcgatttaggagtgccaccacgtctggagcaccgggagtggaaaaggcaagaaatattgttcgccaaaaagcaactgaagtggaggagtgtcaacagtcagaaaatgcacctgcagccggatctggccatctcacagtgggacagcagcagcaggtccttcggagcagcagcacctccgacatccccgagccgctgtgctcagattcttctcagggtcaaaaggcagaaaacacacagaattcgagttcttcagagcctcagcctattcaagagaataaaggacatgtgaagagagaacatgaaggaataacaatcttagttcgaagaagcagcagccctgctgaattggatttgaaagatgatttgcagcagacacaaggaaaatgtagggaaagacagaagagtgaaagtaccaacagtgacacaactctgggctgtaccaatgaggcagagctgtccatgggcccatggcagacctgtgaggaagacccagaactgaatactcccacagatgttgtggctgatgctgatgcccgtcattggttacaactgagtcccaccgatgcttcaaatttaacagatagcagcgagtgcctcacagatgactgtagtataatcgccggggggagcctcactggttggcacccagactctgctgctgtgttatggcgaagggtcttggggatcctcggagatgtgaataacatccagtcacccaagatccatgccagagttttctgctatctctatgaactctggtacaaactagcaaagatacgggataatctagcaataagcctggataaccagtcttctccatctcctccagttttgatcccaccactcagaatgtttgcatcatggctgtttaaggcggcgacactgccaaatgaatataaggaaggcaaactacaagcctacaggctgatctgtgccatgatgaccagacgccaggacgttctgccaaactcagatttcctggtgcatttttaccttgtgatgcacctgggattaaccagcgaggatcaggatatcttaaatacgatcataaggcactgtccaccccgctttttctccctgggttttcctggcttctcaatgctggtgggggacttcatcacggccgctgccagggtccttagcacagacattttgacggcgcctcgttcagaggctgtcactgtcctcggctctctggtctgctttccaaatacctaccaggagattcctttactgcagtcagtgccagaagtaaatgaggccattacaggaactgaagatgtcaagcattacctcataaatattttactgaagaatgccacagaagaaccaaatgaatatgcaagatgcattgctgtttgctcccttggggtctggatatgtgaagagcttgcacagtgtacaagccaccctcaggtgaaagaggccatcaatgtgataggagtaactctgaagtttcccaacaaaatcgtggcccaggtagcttgcgatgtccttcagttgctggtttcctactgggagaagcttcagatgtttgaaacctctctgcctcggaaaatggcagaaatcctcgtggccacagttgcttttcttttaccaagtgcagagtactcctcagtggaaacagacaagaagtttattgtgtccttgctactctgcctcttggactggtgcatggcattgcccgtgagtgtccttctccaccccgtgtccacagcagtcctagaggagcagcattcggccagagcccccttgctggattatatctacagggttttgcactgctgtgtgtgtggctcaagcacgtacacccaacagagtcactacatactgaccctggctgacttgtcatccacggattatgaccccttcctgccactggcaaatgtgaagagctctgagccagtccagtatcattcatcagcagaattgggtaacctgctgactgttgaagaggagaagaagagaagaagtttggagttgatccctttgactgctcgaatggtgatggcccacctggtgaaccacctggggcactaccccctcagtgggggccctgccatactgcacagccttgtcagcgagaaccatgacaatgcccatgtggaaggctccgagctgtcctttgaggtgttcagaagtccaaacctgcagctgtttgtatttaatgatagcaccctcatctcctaccttcagacacccacagaaggaccggtagggggatcaccagtgggctctctctctgatgtgagagtaattgtgagggatatctcagggaagtactcttgggatggtaaggttttatatggacctttggaaggctgcttagcacccaatggaagaaatccttcatttctgatttcgagctggcatcgtgacacatttggacctcagaaagactcttctcaagttgaggagggggatgatgttcttgacaaattacttgaaaacattggccatacaagtcctgaatgccttttaccgtcacagctaaatctaaatgaaccttccctaaccccatgtggcatgaactatgaccaagagaaggaaatcattgaggtcattttgcgccaaaatgctcaagaggatgagtatatccagagtcataacttcgattctgcaatgaaagtcaccagccaagggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttctatgaagagcgagctctgtatctcgaagcaataattcagaaccaccgcgaagtaatgacattcgaggatttcgcagcccaagtcttttctccctctcccagctactccctcagcggaacggattaaaacacgtaaaggtctcatttcaatatttgagcaaggggccctggcctccagtctgagtgctgacctcgaagagcccctgagtgaggaggagacagaacaccctctcctgcctctgccccgagccactaaacccagaatctccaggaaatttcgttgctgtactagtgccctcagcaggtcttcccattagtggacttctgaagcccatggtgaatcccactaccgtgtctcagatgggactcaaactaggctgtatcatcttgtcctgaaacctcacaaaccttggacttccaaagaagaaaagaaaaagtcaccaaaaaccagagatgaacccactgacacgtgggcactggtgtggctgctctgggcagatgacagcaggaaaagattctgcgctttcagggagggggcagagggcagcttgcttctgcaccccaagttgtttcttctcatttatgaacccaagcatgattcacaaaggggctggcaaaacaattgtctaattgaggaatctgatctgcattgattttgctagttccttttatgttaggatttatggtttactcaaaaatttcatcatcatggaaattggctttccccggggtcttttgcccaggagaagttttacctcagttgtccagtgttttcccacatggtacctgacgcccgctaactaagcagaggctctcctcaccacgcagaggcgcttcaggtcatgacagtgatgcccctatcttagaacactcagaagattccagaaatacagggtcctgtccttgcataagttcctgcaggacaggaagtgtcccaaggctcaaaacaacacagaccacatccacacaaaaggcgcatgccggcttcaggcgctaggctgagacgggtaccccccgaatggccttgtgcctccaaaagcctcacgctgcaactttgctgctcctgtctgttgcccagagaggcctcacacaggcctcagaaatgtttcttgtcacacaaagcttttggtagccgattccaagcgagggatttaatccttacatttttgcccatttggctccaaggaaggcttattagacctgtttttttgttgttgttgtttttttttcttaaaaacaaaatgaatgaatgaatgaaaagagaagcaatggtgagccctctcctgctggggcgccctgggtgggccttgccggtcctgcagcagagaaatcagtcagcagcgaagagctgttggcgaaggccccaggctgtgtcctggacccttgacctgcctcagagctagaggtttgctccaccccgcacttcacttgggaagtaaatccaagaagcttaccagagtccat

SEQ ID NO: 425770 - DNA, 5909 bp, Homo sapiens
agtatgcctaaaatcatccagactgttggtggtggtgctgtgcaggagagagcgcctgagctggatggtggtgggcccacggagcaggacaaaagccattctaacagcagcaccttgtcggaccgaagactcagcaactccagcctctgtagcattgaagaagagcaccgaatggtgtatgaaatggtacagcggattctcttgtcaacacgaggttatgtcaacttcgtgaatgaagtatttcaccaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggcctcatctgaaagttctggtcataaacgatcttccagttggggacgcacatactccttcacaagtgcaatgagcagagggtgtgtgacagaggaggaaaatacaaatgtgaaagccggcgtccaggctttgttgcaggtatttttgacgaactctgcaaacatctttttgttggaaccatgtgctgaagttcctgtgctcttgaaagaacaagttgatgcttgtaaagctgttttgattatttttaggcgcatgataatggagcttacaatgaataaaaagacatgggaacagatgttgcaaatactactcaggataacagaagctgtcatgcagaagccaaaggataaacgaataaaggacttgtttgcccagagcttggcagggttactatttaggacgctcatggtagcttggatccgagcaaacctctgtgtgtacatttctcgagagctctgggatgactttcttggtgtgctgtcctccctcacggaatgggaggaacttataaacgagtgggccaacattatggactccttgacagcagtgcttgcaagaaccgtttatggagttgagatgacaaacctacctctggataaattaagtgaacaaaaggaaaagaagcaacgaggcaaaggctgtgttctagatcctcagaaaggaaccaccgtggggaggtccttttctctcagctggcggagccacccagatgtgaccgaaccgatgcgatttaggagtgccaccacgtctggagcaccgggagtggaaaaggcaagaaatattgttcgccaaaaagcaactgaagtggaggagtgtcaacagtcagaaaatgcacctgcagccggatctggccatctcacagtgggacagcagcagcaggtccttcggagcagcagcacctccgacatccccgagccgctgtgctcagattcttctcagggtcaaaaggcagaaaacacacagaattcgagttcttcagagcctcagcctattcaagagaataaaggacatgtgaagagagaacatgaaggaataacaatcttagttcgaagaagcagcagccctgctgaattggatttgaaagatgatttgcagcagacacaaggaaaatgtagggaaagacagaagagtgaaagtaccaacagtgacacaactctgggctgtaccaatgaggcagagctgtccatgggcccatggcagacctgtgaggaagacccagaactgaatactcccacagatgttgtggctgatgctgatgcccgtcattggttacaactgagtcccaccgatgcttcaaatttaacagatagcagcgagtgcctcacagatgactgtagtataatcgccggggggagcctcactggttggcacccagactctgctgctgtgttatggcgaagggtcttggggatcctcggagatgtgaataacatccagtcacccaagatccatgccagagttttctgctatctctatgaactctggtacaaactagcaaagatacgggataatctagcaataagcctggataaccagtcttctccatctcctccagttttgatcccaccactcagaatgtttgcatcatggctgtttaaggcggcgacactgccaaatgaatataaggaaggcaaactacaagcctacaggctgatctgtgccatgatgaccagacgccaggacgttctgccaaactcagatttcctggtgcatttttaccttgtgatgcacctgggattaaccagcgaggatcaggatatcttaaatacgatcataaggcactgtccaccccgctttttctccctgggttttcctggcttctcaatgctggtgggggacttcatcacggccgctgccagggtccttagcacagacattttgacggcgcctcgttcagaggctgtcactgtcctcggctctctggtctgctttccaaatacctaccaggagattcctttactgcagtcagtgccagaagtaaatgaggccattacaggaactgaagatgtcaagcattacctcataaatattttactgaagaatgccacagaagaaccaaatgaatatgcaagatgcattgctgtttgctcccttggggtctggatatgtgaagagcttgcacagtgtacaagccaccctcaggtgaaagaggccatcaatgtgataggagtaactctgaagtttcccaacaaaatcgtggcccaggtagcttgcgatgtccttcagttgctggtttcctactgggagaagcttcagatgtttgaaacctctctgcctcggaaaatggcagaaatcctcgtggccacagttgcttttcttttaccaagtgcagagtactcctcagtggaaacagacaagaagtttattgtgtccttgctactctgcctcttggactggtgcatggcattgcccgtgagtgtccttctccaccccgtgtccacagcagtcctagaggagcagcattcggccagagcccccttgctggattatatctacagggttttgcactgctgtgtgtgtggctcaagcacgtacacccaacagagtcactacatactgaccctggctgacttgtcatccacggattatgaccccttcctgccactggcaaatgtgaagagctctgagccagtccagtatcattcatcagcagaattgggtaacctgctgactgttgaagaggagaagaagagaagaagtttggagttgatccctttgactgctcgaatggtgatggcccacctggtgaaccacctggggcactaccccctcagtgggggccctgccatactgcacagccttgtcagcgagaaccatgacaatgcccatgtggaaggctccgagctgtcctttgaggtgttcagaagtccaaacctgcagctgtttgtatttaatgatagcaccctcatctcctaccttcagacacccacagaaggaccggtagggggatcaccagtgggctctctctctgatgtgagagtaattgtgagggatatctcagggaagtactcttgggatggtaaggttttatatggacctttggaaggctgcttagcacccaatggaagaaatccttcatttctgatttcgagctggcatcgtgacacatttggacctcagaaagactcttctcaagttgaggagggggatgatgttcttgacaaattacttgaaaacattggccatacaagtcctgaatgccttttaccgtcacagctaaatctaaatgaaccttccctaaccccatgtggcatgaactatgaccaagagaaggaaatcattgaggtcattttgcgccaaaatgctcaagaggatgagtatatccagagtcataacttcgattctgcaatgaaagtcaccagccaagggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttgtatctttttgctttaaatgtgtaacttactaaccatcccagaatcaagattcctggcagtttttcataagaggtaagtattcaaaactgaattgaagagggaagagaatttttttcaacctctgttaaaaataacatagtggtttttcatagcatttgttaatttatattaaatataataattttatgctgcattaaacttagagtttactttcataatttactcacatacgtttgtgtctgagaagctgtgaccattatgagatgctcatatcttcttaggtattttgccccacgttcagtctcatcctgtatccctcttatttgtggcagtccattgtatataaggtgggatgctgagcaaaacgtatcgctcattcagagtgcctaccagaaaccaaagcaaatgaaatgaccctaataaatcaaagaatgtggcaggtaccacctgagaagtgcaagtaggtttctggaagatcagaggagatagaaattgcatttggttgagggtagagggaaagatgtcctgaattaagttgcatttggacttatcaataggaatagctagaaattcttttgtaattttcccaaatcattgatattttctctagttcctgattttgtttccaaaaacagaataaatttcactcctaaaattttttcctcaaacattaattggcctgctgtagtccttaaattcaagcatgatctcaagttataagaaaaagagattaagatgggtgaccttataaaattgatgcaaaaaaagtgacctcctaataaaacttagaatctctttgtttctaattggtattgataataatttgaaacatattgtgtttgacctctatatatacttctcccaacctgatagtaagtgatgtgttgctatagcaagtgagagttgggggtagatgaaaactatcccatgtgaatagatacggttcatgaaaaaatacctttcattaaaatcctggtcacttcattgactgatattctgcctttagattaaaaaaaaatacatatgccatgtggcaacttaaaattatcatagaaatgagtagtagaaaagagctattaggtcccatctggtccctcccctgggggccagggcaggattattcccttcagtgtactctctcgtgctttgtccaggctggtggtgagtgttttggagatggcattctttgcagtgatttccacaacactgtagacgtaatcttgtggctggtgtcaatttggccttcagcatggagtttttatttcacatactattaaaaagagcctcttggcagaaatgagaaagaactattcagcgattagtttgtcagtttgcatgtcaactaggacgagctgggcacgcatcagtcaagtatgttggaccaaggcagcaaaaaa

SEQ ID NO: 425771 - DNA, 4790 bp, Homo sapiens
agtatgcctaaaatcatccagactgttggtggtggtgctgtgcaggagagagcgcctgagctggatggtggtgggcccacggagcaggacaaaagccattctaacagcagcaccttgtcggaccgaagactcagcaactccagcctctgtagcattgaagaagagcaccgaatggtgtatgaaatggtacagcggattctcttgtcaacacgaggttatgtcaacttcgtgaatgaagtatttcaccaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggcctcatctgaaagttctggtcataaacgatcttccagttggggacgcacatactccttcacaagtgcaatgagcagagggtgtgtgacagaggaggaaaatacaaatgtgaaagccggcgtccaggctttgttgcaggtatttttgacgaactctgcaaacatctttttgttggaaccatgtgctgaagttcctgtgctcttgaaagaacaagttgatgcttgtaaagctgttttgattatttttaggcgcatgataatggagcttacaatgaataaaaagacatgggaacagatgttgcaaatactactcaggataacagaagctgtcatgcagaagccaaaggataaacgaataaaggacttgtttgcccagagcttggcagggttactatttaggacgctcatggtagcttggatccgagcaaacctctgtgtgtacatttctcgagagctctgggatgactttcttggtgtgctgtcctccctcacggaatgggaggaacttataaacgagtgggccaacattatggactccttgacagcagtgcttgcaagaaccgtttatggagttgagatgacaaacctacctctggataaattaagtgaacaaaaggaaaagaagcaacgaggcaaaggctgtgttctagatcctcagaaaggaaccaccgtggggaggtccttttctctcagctggcggagccacccagatgtgaccgaaccgatgcgatttaggagtgccaccacgtctggagcaccgggagtggaaaaggcaagaaatattgttcgccaaaaagcaactgaagtggaggagtgtcaacagtcagaaaatgcacctgcagccggatctggccatctcacagtgggacagcagcagcaggtccttcggagcagcagcacctccgacatccccgagccgctgtgctcagattcttctcagggtcaaaaggcagaaaacacacagaattcgagttcttcagagcctcagcctattcaagagaataaaggacatgtgaagagagaacatgaaggaataacaatcttagttcgaagaagcagcagccctgctgaattggatttgaaagatgatttgcagcagacacaaggaaaatgtagggaaagacagaagagtgaaagtaccaacagtgacacaactctgggctgtaccaatgaggcagagctgtccatgggcccatggcagacctgtgaggaagacccagaactgaatactcccacagatgttgtggctgatgctgatgcccgtcattggttacaactgagtcccaccgatgcttcaaatttaacagatagcagcgagtgcctcacagatgactgtagtataatcgccggggggagcctcactggttggcacccagactctgctgctgtgttatggcgaagggtcttggggatcctcggagatgtgaataacatccagtcacccaagatccatgccagagttttctgctatctctatgaactctggtacaaactagcaaagatacgggataatctagcaataagcctggataaccagtcttctccatctcctccagttttgatcccaccactcagaatgtttgcatcatggctgtttaaggcggcgacactgccaaatgaatataaggaaggcaaactacaagcctacaggctgatctgtgccatgatgaccagacgccaggacgttctgccaaactcagatttcctggtgcatttttaccttgtgatgcacctgggattaaccagcgaggatcaggatatcttaaatacgatcataaggcactgtccaccccgctttttctccctgggttttcctggcttctcaatgctggtgggggacttcatcacggccgctgccagggtccttagcacagacattttgacggcgcctcgttcagaggctgtcactgtcctcggctctctggtctgctttccaaatacctaccaggagattcctttactgcagtcagtgccagaagtaaatgaggccattacaggaactgaagatgtcaagcattacctcataaatattttactgaagaatgccacagaagaaccaaatgaatatgcaagatgcattgctgtttgctcccttggggtctggatatgtgaagagcttgcacagtgtacaagccaccctcaggtgaaagaggccatcaatgtgataggagtaactctgaagtttcccaacaaaatcgtggcccaggtagcttgcgatgtccttcagttgctggtttcctactgggagaagcttcagatgtttgaaacctctctgcctcggaaaatggcagaaatcctcgtggccacagttgcttttcttttaccaagtgcagagtactcctcagtggaaacagacaagaagtttattgtgtccttgctactctgcctcttggactggtgcatggcattgcccgtgagtgtccttctccaccccgtgtccacagcagtcctagaggagcagcattcggccagagcccccttgctggattatatctacagggttttgcactgctgtgtgtgtggctcaagcacgtacacccaacagagtcactacatactgaccctggctgacttgtcatccacggattatgaccccttcctgccactggcaaatgtgaagagctctgagccagtccagtatcattcatcagcagaattgggtaacctgctgactgttgaagaggagaagaagagaagaagtttggagttgatccctttgactgctcgaatggtgatggcccacctggtgaaccacctggggcactaccccctcagtgggggccctgccatactgcacagccttgtcagcgagaaccatgacaatgcccatgtggaaggctccgagctgtcctttgaggtgttcagaagtccaaacctgcagctgtttgtatttaatgatagcaccctcatctcctaccttcagacacccacagaaggaccggtagggggatcaccagtgggctctctctctgatgtgagagtaattgtgagggatatctcagggaagtactcttgggatggtaaggttttatatggacctttggaaggctgcttagcacccaatggaagaaatccttcatttctgatttcgagctggcatcgtgacacatttggacctcagaaagactcttctcaagttgaggagggggatgatgttcttgacaaattacttgaaaacattggccatacaagtcctgaatgccttttaccgtcacagctaaatctaaatgaaccttccctaaccccatgtggcatgaactatgaccaagagaaggaaatcattgaggtcattttgcgccaaaatgctcaagaggatgagtatatccagagtcataacttcgattctgcaatgaaagtcaccagccaagggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggtacgttttcattgcattgttgtactgactcataaagcatttgccatgtgattcattgtcattgaaaatcagtgatacaaatatgttaaaggggactctcatccagttgttgaatgtcttacatatatctgaattatgcatgctttataggaattaaatatgaattgggattttcaaagaatttttcatcatgagcacaaaattgtattattgtattactaggcctctttggaaattataatgtcaaatttattattttgtaaatgttttaagttttctaaattttgtacttttgaaaaattgtatcttgaaattttggttatgttgattaataataagagttgaaggaaccccatatcacatctagcattttgtggagaaccgtgggtatggaatccagccttgcc

SEQ ID NO: 425772 - DNA, 1561 bp, Homo sapiens
agtatgcctaaaatcatccagactgttggtggtggtgctgtgcaggagagagcgcctgagctggatggtggtgggcccacggagcaggacaaaagccattctaacagcagcaccttgtcggaccgaagactcagcaactccagcctctgtagcattgaagaagagcaccgaatggtgtatgaaatggtacagcggattctcttgtcaacacgaggttatgtcaacttcgtgaatgaagtatttcaccaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggcctcatctgaaagttctggtcataaacgatcttccagttggggacgcacatactccttcacaagtgcaatgagcagagggtgtgtgacagaggaggaaaatacaaatgtgaaagccggcgtccaggctttgttgcaggtatttttgacgaactctgcaaacatctttttgttggaaccatgtgctgaagttcctgtgctcttgaaagaacaagttgatgcttgtaaagctgttttgattatttttaggcgcatgataatggagcttacaatgaataaaaagacatgggaacagatgttgcaaatactactcaggataacagaagctgtcatgcagaagccaaaggataaacgaataaaggacttgtttgcccagagcttggcagggttactatttaggacgctcatggtagcttggatccgagcaaacctctgtgtgtacatttctcgagagctctgggatgactttcttggtgtgctgtcctccctcacggaatgggaggaacttataaacgagtgggccaacattatggactccttgacagcagtgcttgcaagaaccgtttatggagttgagatgacaaacctacctctggataaattaagtgaacaaaaggaaaagaagcaacgaggcaaaggtatttccactcttccaggttaacaccagatgtctaggactggggacgagtgtgtatttgtatgactaagcaattaatgcgcgaaattttataatgaactgaaccaactacacagtgtcttcttaatagtggcattaatttgtgtctcatatcattctgttcccttaatgagatggtgaatttctgaggaagctatgcaagaaggaagatgcaaggaaggtagtagtaatagtagtgataactaacagtaataataatggctattacattgtacatattatctctttttaccttcataataacctagtgaactgtagatacttgtattatccccatatcacagacaaagaaactgaagtacagagactttgcagggatgtccaatcctttggcttccccaggccacattggaagaattgtcttaggtcacacataaaatacagtaaaactaacgatagctgatgagctaaaacaaaaaaagaaattgcaaaaaaaaaaaagtcgacg

SEQ ID NO: 425773 - DNA, 269 bp, Homo sapiens
gggcagccctccccagtggagccccgaggacccttttatttctgcaggttattgcttgatgacttgggaatgaattcttgggacagaaggtaacaatccaagctagacctccagttattttatcattattttcatgtacttgttctttttatcagtttgtggttggggaagaagaaaagattggggaagagaggagaagggagatttttctttattttaacatttgcagcttattttctgctactaaattaaagctagaaatgaaatta

SEQ ID NO: 425774 - DNA, 603 bp, Homo sapiens
gaatatgggcaagaatgtgagtccatgggcagaggttgaggggagtctcattgaatgggttctgtttcttgtgaagtctgcagtgaatccatctgctcaaagtcagggaggatttggtgggctggcggttttcctgtaggaggtttgaagtagccactgtggatggtaggaaaagagcagtctcaggaagcagagttgtcactgtgcggagggctttgtcttttctctgattatagccagggccagctgcagacactagaacaatattgaatcagtaactttgttcataatgataactaactccccaatagcttaaattttgattatagttggtcaaatgaattttgagaattaaaagaaaaacaacttccaaaagtactttttattttaaaatttgtgttattaatagtaatttaaaacattttgtttaaaagtatgctttttccaaatgaagatgtgtgaattctcttgttggttggttggttttagacgctcatggtagcttggatccgagcaaacctctgtgtgtacatttctcgagagctctgggatgactttcttggtgtgctgtcctccctcacggaatgggaggaacttataaac

SEQ ID NO: 425775 - DNA, 2196 bp, Homo sapiens
cgccggtcggttggtggcgcctttgtcctacggcgggcaggtgggccgacgcggaggcggcagcggcgggcctgaggcgaaggagcggccgggagcccgccgcgctggtagcgatattaataaggcagcggaaagaagaaatatgaatacggctccatcaagacccagccccacacgaagggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggagagaaggctcttatgaccgatacctacgaatggatgactattgcaggagaaaggatgactcttattttgaccgttacagagatagctttgatggacggggccctccaggcccagaaagtcagtctcgtgcaaaagagcgtttgaaacgtgaggaacggcgtagagaagagctttatcgtcaatattttgaggaaatccagagacgctttgatgccgaaaggcccgttgattgttctgtgattgtggtcaacaaacagacaaaagactatgctgagtctgtggggcggaaggtgcgagacctgggcatggtagtggacttgatcttccttaacacagaagtgtcactgtcacaagccttggaggatgttagcaggggaggttctccttttgctattgtcatcacccagcaacaccagattcaccgctcctgcacagtcaacatcatgtttggaaccccgcaagagcatcgcaacatgccccaagcagatgccatggtgctggtggccagaaattatgagcgttacaagaatgagtgccgggagaaggaacgtgaggagattgccagacaggcagccaagatggccgatgaagccatcctgcaggaaagagagagaggaggccctgaggagggagtgcgtgggggccaccctccagccatccagagcctcatcaacctgctggcagacaacaggtacctcactgctgaagagactgacaagatcatcaactacctgcgagagcggaaggagcggctgatgaggagcagcaccgactctctgcctggcccgatttcccgccaaccactcggggcgacctcgggtgcctcgctgaagacacagccaagctcccaaccgctccagagcggccaagtgctcccctctgctacacccactccatctgcaccccccacctcccagcaagagcttcaggccaaaatcctcagcctcttcaatagtggcacagtgacggccaatagcagctctgcatccccctcggttgctgccggaaacaccccaaaccagaatttttccacagcagcaaacagccagcctcaacaaagatcacaggcttctggcaatcagcctccaagcattttgggacagggaggatctgctcagaacatgggccccagacctggggctccttcccaagggctttttggccagccttccagtcgcctggcacctgctagcaacatgactagccagaggcctgtgtcttccacaggtatcaactttgacaatccaagtgtacagaaggctctggataccctgatccagagtggccctgctctctcccacctggttagccagaccacagcacagatggggcagccacaggcccccatgggatcttaccagaggcattactgaagctaaatctttcaactctccccagtcccctcatcccctggcctcctcccacttacttgttctaaatagagctgtttggaggatgttctctgcgctcccaggccggcatcgagtgtcatcaatttctaccacctgctctctcttctgcccaaggctgtgttgcttattccttacaaagtttatactgcatttggggctgtatctttttttgtttttttggttttttttttcctctttggaactcttgtgttgttaataaaatgaaatgattactttttaattaaaatgaaaaagtaaaagctttgttcatcttt

SEQ ID NO: 425776 - DNA, 3211 bp, Homo sapiens
cgccggtcggttggtggcgcctttgtcctacggcgggcaggtgggccgacgcggaggcggcagcggcgggcctgaggcgaaggagcggccgggagcccgccgcgctggtagcgatattaataaggcagcggaaagaagaaatatgaatacggctccatcaagacccagccccacacgaagggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggagagaaggctcttatgaccgatacctacgaatggatgactattgcaggagaaaggatgactcttattttgaccgttacagagatagctttgatggacggggccctccaggcccagaaagtcagtctcgtgcaaaagagcgtttgaaacgtgaggaacggcgtagagaagagctttatcgtcaatattttgaggaaatccagagacgctttgatgccgaaaggcccgttgattgttctgtgattgtggtcaacaaacagacaaaagactatgctgagtctgtggggcggaaggtgcgagacctgggcatggtagtggacttgatcttccttaacacagaagtgtcactgtcacaagccttggaggatgttagcaggggaggttctccttttgctattgtcatcacccagcaacaccagattcaccgctcctgcacagtcaacatcatgtttggaaccccgcaagagcatcgcaacatgccccaagcagatgccatggtgctggtggccagaaattatgagcgttacaagaatgagtgccgggagaaggaacgtgaggagattgccagacaggcagccaagatggccgatgaagccatcctgcaggaaagagagagaggaggccctgaggagggagtgcgtgggggccaccctccagccatccagagcctcatcaacctgctggcagacaacaggtacctcactgctgaagagactgacaagatcatcaactacctgcgagagcggaaggagcggctgatgaggagcagcaccgactctctgcctggcccgatttcccgccaaccactcggggcgacctcgggtgcctcgctgaagacacagccaagctcccaaccgctccagagcggccaagtgctcccctctgctacacccactccatctgcaccccccacctcccagcaagagcttcaggccaaaatcctcagcctcttcaatagtggcacagtgacggccaatagcagctctgcatccccctcggttgctgccggaaacaccccaaaccagaatttttccacagcagcaaacagccagcctcaacaaagatcacaggcttctggcaatcagcctccaagcattttgggacagggaggatctgctcagaacatgggccccagacctggggctccttcccaagggctttttggccagccttccagtcgcctggcacctgctagcaacatgactagccagaggcctgtgtcttccacaggtatcaactttgacaatccaagtgtacagaaggctctggataccctgatccagagtggccctgctctctcccacctggttagccagaccacagcacagatggggcagccacaggcccccatgggatcttaccagaggcattactgaagctaaatctttcaactctccccagtcccctcatcccctggcctcctcccacttacttgttctaaatagagctgtttggaggatgttctctgcgctcccaggccggcatcgagtgtcatcaatttctaccacctgctctctcttctgcccaaggctgtgttgcttattccttacaaagtttatactgcatttggggctgtatctttttttgttttttgttttgtagaaaataaatatctccgggggcagtacaggtgtctgggcttgtatttgatggggtttctccggtccctgtttctactggatttggagccaggcccagctagccaagtttggaatggcatttgtcatgtcagtagccaccacctttgttcattgtgaacctaccaaggctttccagcttcatacacattgaccagagctcaagctcctgcctgcaactcctgcctagagttgaagaaaagcaaactggccttggcaggcacagtgtcatcataccctcaccccatatgtttggggtctgcttgaggattcataaatcagccactctggattgttgaggaatggccatggcagccacagaaaaaagaatttttctctctgagccaaggttgttttttgtttttttctcttttcttttttgttttcatttcattggaagatctccaatggactgaacagctccagtcagcagcagttaccacaaactgtgaatctgggccccaccactcttccctgttaaccagttctgtcagcatccccctctccagcagcacttccatgaagttggttctgagactctggccgtgaacacccgtttcttcagtgatttgttttgggcttttggctcaaaaccccaggctcttgtttttgtctagactcttattctgtttcctgagcagcaggaggtagggaccactttgatgtcagacttctggtagctggacatgttctcgagatgggtggctgttcgcgacttttgtaccagagtgaaattgttagaaggagggtttctggctgtggttctaaatggagccccaggaagctgccctctccccagggtttgtgctcagtagagccctgtggatcacagtcttgaggtcctctagcaggggtgagggagagcagcgacttcagctgagtccctgccagtggttaagcaaacaatggtttcaaaattcaaggtccccaaatggcagcattttatgttctgacctgtttgtgttatatagtggttttttttttcctctttggaactcttgtgttgttaataaaatgaaatgattactttttaattaaaatgaaaaagtaaaagctttgttcatcttt

SEQ ID NO: 425777 - DNA, 3144 bp, Homo sapiens
cgccggtcggttggtggcgcctttgtcctacggcgggcaggtgggccgacgcggaggcggcagcggcgggcctgaggcgaaggagcggccgggagcccgccgcgctggtagcgggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggagagaaggctcttatgaccgatacctacgaatggatgactattgcaggagaaaggatgactcttattttgaccgttacagagatagctttgatggacggggccctccaggcccagaaagtcagtctcgtgcaaaagagcgtttgaaacgtgaggaacggcgtagagaagagctttatcgtcaatattttgaggaaatccagagacgctttgatgccgaaaggcccgttgattgttctgtgattgtggtcaacaaacagacaaaagactatgctgagtctgtggggcggaaggtgcgagacctgggcatggtagtggacttgatcttccttaacacagaagtgtcactgtcacaagccttggaggatgttagcaggggaggttctccttttgctattgtcatcacccagcaacaccagattcaccgctcctgcacagtcaacatcatgtttggaaccccgcaagagcatcgcaacatgccccaagcagatgccatggtgctggtggccagaaattatgagcgttacaagaatgagtgccgggagaaggaacgtgaggagattgccagacaggcagccaagatggccgatgaagccatcctgcaggaaagagagagaggaggccctgaggagggagtgcgtgggggccaccctccagccatccagagcctcatcaacctgctggcagacaacaggtacctcactgctgaagagactgacaagatcatcaactacctgcgagagcggaaggagcggctgatgaggagcagcaccgactctctgcctggcccgatttcccgccaaccactcggggcgacctcgggtgcctcgctgaagacacagccaagctcccaaccgctccagagcggccaagtgctcccctctgctacacccactccatctgcaccccccacctcccagcaagagcttcaggccaaaatcctcagcctcttcaatagtggcacagtgacggccaatagcagctctgcatccccctcggttgctgccggaaacaccccaaaccagaatttttccacagcagcaaacagccagcctcaacaaagatcacaggcttctggcaatcagcctccaagcattttgggacagggaggatctgctcagaacatgggccccagacctggggctccttcccaagggctttttggccagccttccagtcgcctggcacctgctagcaacatgactagccagaggcctgtgtcttccacaggtatcaactttgacaatccaagtgtacagaaggctctggataccctgatccagagtggccctgctctctcccacctggttagccagaccacagcacagatggggcagccacaggcccccatgggatcttaccagaggcattactgaagctaaatctttcaactctccccagtcccctcatcccctggcctcctcccacttacttgttctaaatagagctgtttggaggatgttctctgcgctcccaggccggcatcgagtgtcatcaatttctaccacctgctctctcttctgcccaaggctgtgttgcttattccttacaaagtttatactgcatttggggctgtatctttttttgttttttgttttgtagaaaataaatatctccgggggcagtacaggtgtctgggcttgtatttgatggggtttctccggtccctgtttctactggatttggagccaggcccagctagccaagtttggaatggcatttgtcatgtcagtagccaccacctttgttcattgtgaacctaccaaggctttccagcttcatacacattgaccagagctcaagctcctgcctgcaactcctgcctagagttgaagaaaagcaaactggccttggcaggcacagtgtcatcataccctcaccccatatgtttggggtctgcttgaggattcataaatcagccactctggattgttgaggaatggccatggcagccacagaaaaaagaatttttctctctgagccaaggttgttttttgtttttttctcttttcttttttgttttcatttcattggaagatctccaatggactgaacagctccagtcagcagcagttaccacaaactgtgaatctgggccccaccactcttccctgttaaccagttctgtcagcatccccctctccagcagcacttccatgaagttggttctgagactctggccgtgaacacccgtttcttcagtgatttgttttgggcttttggctcaaaaccccaggctcttgtttttgtctagactcttattctgtttcctgagcagcaggaggtagggaccactttgatgtcagacttctggtagctggacatgttctcgagatgggtggctgttcgcgacttttgtaccagagtgaaattgttagaaggagggtttctggctgtggttctaaatggagccccaggaagctgccctctccccagggtttgtgctcagtagagccctgtggatcacagtcttgaggtcctctagcaggggtgagggagagcagcgacttcagctgagtccctgccagtggttaagcaaacaatggtttcaaaattcaaggtccccaaatggcagcattttatgttctgacctgtttgtgttatatagtggttttttttttcctctttggaactcttgtgttgttaataaaatgaaatgattactttttaattaaaatgaaaaagtaaaagctttgttcatcttt

SEQ ID NO: 425778 - DNA, 3681 bp, Homo sapiens
cgccggtcggttggtggcgcctttgtcctacggcgggcaggtgggccgacgcggaggcggcagcggcgggcctgaggcgaaggagcggccgggagcccgccgcgctggtagcgatattaataaggcagcggaaagaagaaatatgaatacggctccatcaagacccagccccacacgaagggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggagagaaggctcttatgaccgatacctacgaatggatgactattgcaggagaaaggatgactcttattttgaccgttacagagatagctttgatggacggggccctccaggcccagaaagtcagtctcgtgcaaaagagcgtttgaaacgtgaggaacggcgtagagaagagctttatcgtcaatattttgaggaaatccagagacgctttgatgccgaaaggcccgttgattgttctgtgattgtggtcaacaaacagacaaaagactatgctgagtctgtggggcggaaggtgcgagacctgggcatggtagtggacttgatcttccttaacacagaagtgtcactgtcacaagccttggaggatgttagcaggggaggttctccttttgctattgtcatcacccagcaacaccagattcaccgctcctgcacagtcaacatcatgtttggaaccccgcaagagcatcgcaacatgccccaagcagatgccatggtgctggtggccagaaattatgagcgttacaagaatgagtgccgggagaaggaacgtgaggagattgccagacaggcagccaagatggccgatgaagccatcctgcaggaaagagagagaggaggccctgaggagggagtgcgtgggggccaccctccagccatccagagcctcatcaacctgctggcagacaacaggtacctcactgctgaagagactgacaagatcatcaactacctgcgagagcggaaggagcggctgatgaggagcagcaccgactctctgcctggtgagctacgtggcagggccgaggtgaagttctgactctgcatttctctaatccccaggctctgttgggagggtgtcaggcccagggctctttggagtgggtaagggaactaagtccatcccttgggttctcccgtgggccacccatgctgatataatgttaataataactttatatttgggtactgaatgctgatccctatagttaatgtggtggattgactagtattgctggctccgtggtagccaggatggatgcccttttgttttttagcagttctctaggggaactagcctattgttttctgtaaacagcacatatcatgaagcggcctctttgggaaattgatgttatcgtctgtgtactgtatgattgatgtgactcagtgattgttgttcttcctttggctgctaggcctcctgcccttggggggtactttgaaccagatacctccctcttctgtcttccaggcccgatttcccgccaaccactcggggcgacctcgggtgcctcgctgaagacacagccaagctcccaaccgctccagagcggccaagtgctcccctctgctacacccactccatctgcaccccccacctcccagcaagagcttcaggccaaaatcctcagcctcttcaatagtggcacagtgacggccaatagcagctctgcatccccctcggttgctgccggaaacaccccaaaccagaatttttccacagcagcaaacagccagcctcaacaaagatcacaggcttctggcaatcagcctccaagcattttgggacagggaggatctgctcagaacatgggccccagacctggggctccttcccaagggctttttggccagccttccagtcgcctggcacctgctagcaacatgactagccagaggcctgtgtcttccacaggtatcaactttgacaatccaagtgtacagaaggctctggataccctgatccagagtggccctgctctctcccacctggttagccagaccacagcacagatggggcagccacaggcccccatgggatcttaccagaggcattactgaagctaaatctttcaactctccccagtcccctcatcccctggcctcctcccacttacttgttctaaatagagctgtttggaggatgttctctgcgctcccaggccggcatcgagtgtcatcaatttctaccacctgctctctcttctgcccaaggctgtgttgcttattccttacaaagtttatactgcatttggggctgtatctttttttgttttttgttttgtagaaaataaatatctccgggggcagtacaggtgtctgggcttgtatttgatggggtttctccggtccctgtttctactggatttggagccaggcccagctagccaagtttggaatggcatttgtcatgtcagtagccaccacctttgttcattgtgaacctaccaaggctttccagcttcatacacattgaccagagctcaagctcctgcctgcaactcctgcctagagttgaagaaaagcaaactggccttggcaggcacagtgtcatcataccctcaccccatatgtttggggtctgcttgaggattcataaatcagccactctggattgttgaggaatggccatggcagccacagaaaaaagaatttttctctctgagccaaggttgttttttgtttttttctcttttcttttttgttttcatttcattggaagatctccaatggactgaacagctccagtcagcagcagttaccacaaactgtgaatctgggccccaccactcttccctgttaaccagttctgtcagcatccccctctccagcagcacttccatgaagttggttctgagactctggccgtgaacacccgtttcttcagtgatttgttttgggcttttggctcaaaaccccaggctcttgtttttgtctagactcttattctgtttcctgagcagcaggaggtagggaccactttgatgtcagacttctggtagctggacatgttctcgagatgggtggctgttcgcgacttttgtaccagagtgaaattgttagaaggagggtttctggctgtggttctaaatggagccccaggaagctgccctctccccagggtttgtgctcagtagagccctgtggatcacagtcttgaggtcctctagcaggggtgagggagagcagcgacttcagctgagtccctgccagtggttaagcaaacaatggtttcaaaattcaaggtccccaaatggcagcattttatgttctgacctgtttgtgttatatagtggttttttttttcctctttggaactcttgtgttgttaataaaatgaaatgattactttttaattaaaatgaaaaagtaaaagctttgttcatcttt

SEQ ID NO: 425779 - DNA, 3105 bp, Homo sapiens
cgccggtcggttggtggcgcctttgtcctacggcgggcaggtgggccgacgcggaggcggcagcggcgggcctgaggcgaaggagcggccgggagcccgccgcgctggtagcgatattaataaggcagcggaaagaagaaatatgaatacggctccatcaagacccagccccacacgaagggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggagagaaggctcttatgaccgatacctacgaatggatgactattgcaggagaaaggatgactcttattttgaccgttacagagatagctttgatggacggggccctccaggcccagaaagtcagtctcgtgcaaaagagcgtttgaaacgtgaggaacggcgtagagaagagctttatcgtcaatattttgaggaaatccagagacgctttgatgccgaaaggcccgttgattgttctgtgattgtggtcaacaaacagacaaaagactatgctgagtctgtggggcggaaggtgcgagacctgggcatggtagtggacttgatcttccttaacacagaagtgtcactgtcacaagccttggaggatgttagcaggggaggttctccttttgctattgtcatcacccagcaacaccagattcaccgctcctgcacagtaaggaacgtgaggagattgccagacaggcagccaagatggccgatgaagccatcctgcaggaaagagagagaggaggccctgaggagggagtgcgtgggggccaccctccagccatccagagcctcatcaacctgctggcagacaacaggtacctcactgctgaagagactgacaagatcatcaactacctgcgagagcggaaggagcggctgatgaggagcagcaccgactctctgcctggcccgatttcccgccaaccactcggggcgacctcgggtgcctcgctgaagacacagccaagctcccaaccgctccagagcggccaagtgctcccctctgctacacccactccatctgcaccccccacctcccagcaagagcttcaggccaaaatcctcagcctcttcaatagtggcacagtgacggccaatagcagctctgcatccccctcggttgctgccggaaacaccccaaaccagaatttttccacagcagcaaacagccagcctcaacaaagatcacaggcttctggcaatcagcctccaagcattttgggacagggaggatctgctcagaacatgggccccagacctggggctccttcccaagggctttttggccagccttccagtcgcctggcacctgctagcaacatgactagccagaggcctgtgtcttccacaggtatcaactttgacaatccaagtgtacagaaggctctggataccctgatccagagtggccctgctctctcccacctggttagccagaccacagcacagatggggcagccacaggcccccatgggatcttaccagaggcattactgaagctaaatctttcaactctccccagtcccctcatcccctggcctcctcccacttacttgttctaaatagagctgtttggaggatgttctctgcgctcccaggccggcatcgagtgtcatcaatttctaccacctgctctctcttctgcccaaggctgtgttgcttattccttacaaagtttatactgcatttggggctgtatctttttttgttttttgttttgtagaaaataaatatctccgggggcagtacaggtgtctgggcttgtatttgatggggtttctccggtccctgtttctactggatttggagccaggcccagctagccaagtttggaatggcatttgtcatgtcagtagccaccacctttgttcattgtgaacctaccaaggctttccagcttcatacacattgaccagagctcaagctcctgcctgcaactcctgcctagagttgaagaaaagcaaactggccttggcaggcacagtgtcatcataccctcaccccatatgtttggggtctgcttgaggattcataaatcagccactctggattgttgaggaatggccatggcagccacagaaaaaagaatttttctctctgagccaaggttgttttttgtttttttctcttttcttttttgttttcatttcattggaagatctccaatggactgaacagctccagtcagcagcagttaccacaaactgtgaatctgggccccaccactcttccctgttaaccagttctgtcagcatccccctctccagcagcacttccatgaagttggttctgagactctggccgtgaacacccgtttcttcagtgatttgttttgggcttttggctcaaaaccccaggctcttgtttttgtctagactcttattctgtttcctgagcagcaggaggtagggaccactttgatgtcagacttctggtagctggacatgttctcgagatgggtggctgttcgcgacttttgtaccagagtgaaattgttagaaggagggtttctggctgtggttctaaatggagccccaggaagctgccctctccccagggtttgtgctcagtagagccctgtggatcacagtcttgaggtcctctagcaggggtgagggagagcagcgacttcagctgagtccctgccagtggttaagcaaacaatggtttcaaaattcaaggtccccaaatggcagcattttatgttctgacctgtttgtgttatatagtggttttttttttcctctttggaactcttgtgttgttaataaaatgaaatgattactttttaattaaaatgaaaaagtaaaagctttgttcatcttt

SEQ ID NO: 425780 - DNA, 2549 bp, Homo sapiens
cgccggtcggttggtggcgcctttgtcctacggcgggcaggtgggccgacgcggaggcggcagcggcgggcctgaggcgaaggagcggccgggagcccgccgcgctggtagcgatattaataaggcagcggaaagaagaaatatgaatacggctccatcaagacccagccccacacgaagggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggagagaaggctcttatgaccgatacctacgaatggatgactattgcaggagaaaggatgactcttattttgaccgttacagagatagctttgatggacggggccctccaggcccagaaagtcagtctcgtgcaaaagagcgtttgaaacgtgaggaacggcgtagagaagagctttatcgtcaatattttgaggaaatccagagacgctttgatgccgaaaggcccgttgattgttctgtgattgtggtcaacaaacagacaaaagactatgctgagtctgtggggcggaaggtgcgagacctgggcatggtagtggacttgatcttccttaacacagaagtgtcactgtcacaagccttggaggatgttagcaggggaggttctccttttgctattgtcatcacccagcaacaccagattcaccgctcctgcacagtcaacatcatgtttggaaccccgcaagagcatcgcaacatgccccaagcagatgccatggtgctggtggccagaaattatgagcgttacaagaatgagtgccgggagaaggaacgtgaggagattgccagacaggcagccaagatggccgatgaagccatcctgcaggaaagagagagaggaggccctgaggagggagtgcgtgggggccaccctccagccatccagagcctcatcaacctgctggcagacaacaggtacctcactgctgaagagactgacaagatcatcaatctccccagtcccctcatcccctggcctcctcccacttacttgttctaaatagagctgtttggaggatgttctctgcgctcccaggccggcatcgagtgtcatcaatttctaccacctgctctctcttctgcccaaggctgtgttgcttattccttacaaagtttatactgcatttggggctgtatctttttttgttttttgttttgtagaaaataaatatctccgggggcagtacaggtgtctgggcttgtatttgatggggtttctccggtccctgtttctactggatttggagccaggcccagctagccaagtttggaatggcatttgtcatgtcagtagccaccacctttgttcattgtgaacctaccaaggctttccagcttcatacacattgaccagagctcaagctcctgcctgcaactcctgcctagagttgaagaaaagcaaactggccttggcaggcacagtgtcatcataccctcaccccatatgtttggggtctgcttgaggattcataaatcagccactctggattgttgaggaatggccatggcagccacagaaaaaagaatttttctctctgagccaaggttgttttttgtttttttctcttttcttttttgttttcatttcattggaagatctccaatggactgaacagctccagtcagcagcagttaccacaaactgtgaatctgggccccaccactcttccctgttaaccagttctgtcagcatccccctctccagcagcacttccatgaagttggttctgagactctggccgtgaacacccgtttcttcagtgatttgttttgggcttttggctcaaaaccccaggctcttgtttttgtctagactcttattctgtttcctgagcagcaggaggtagggaccactttgatgtcagacttctggtagctggacatgttctcgagatgggtggctgttcgcgacttttgtaccagagtgaaattgttagaaggagggtttctggctgtggttctaaatggagccccaggaagctgccctctccccagggtttgtgctcagtagagccctgtggatcacagtcttgaggtcctctagcaggggtgagggagagcagcgacttcagctgagtccctgccagtggttaagcaaacaatggtttcaaaattcaaggtccccaaatggcagcattttatgttctgacctgtttgtgttatatagtggttttttttttcctctttggaactcttgtgttgttaataaaatgaaatgattactttttaattaaaatgaaaaagtaaaagctttgttcatcttt

SEQ ID NO: 425781 - DNA, 2573 bp, Homo sapiens
gggagtggagagagaatggggaggtatctggttcaaagtaccccccaagggcaggaggctagcagccaaaggaagaacaacaatcactgagtcacatcaatcatacagtacacagacgataacatcaactacctgcgagagcggaaggagcggctgatgaggagcagcaccgactctctgcctggtgagctacgtggcagggccgaggtgaagttctgactctgcatttctctaatccccaggctctgttgggagggtgtcaggcccagggctctttggagtgggtaagggaactaagtccatcccttgggttctcccgtgggccacccatgctgatataatgttaataataactttatatttgggtactgaatgctgatccctatagttaatgtggtggattgactagtattgctggctccgtggtagccaggatggatgcccttttgttttttagcagttctctaggggaactagcctattgttttctgtaaacagcacatatcatgaagcggcctctttgggaaattgatgttatcgtctgtgtactgtatgattgatgtgactcagtgattgttgttcttcctttggctgctaggcctcctgcccttggggggtactttgaaccagatacctccctcttctgtcttccaggcccgatttcccgccaaccactcggggcgacctcgggtgcctcgctgaagacacagccaagctcccaaccgctccagagcggccaagtgctcccctctgctacacccactccatctgcaccccccacctcccagcaagagcttcaggccaaaatcctcagcctcttcaatagtggcacagtgacggccaatagcagctctgcatccccctcggttgctgccggaaacaccccaaaccagaatttttccacagcagcaaacagccagcctcaacaaagatcacaggcttctggcaatcagcctccaagcattttgggacagggaggatctgctcagaacatgggccccagacctggggctccttcccaagggctttttggccagccttccagtcgcctggcacctgctagcaacatgactagccagaggcctgtgtcttccacaggtatcaactttgacaatccaagtgtacagaaggctctggataccctgatccagagtggccctgctctctcccacctggttagccagaccacagcacagatggggcagccacaggcccccatgggatcttaccagaggcattactgaagctaaatctttcaactctccccagtcccctcatcccctggcctcctcccacttacttgttctaaatagagctgtttggaggatgttctctgcgctcccaggccggcatcgagtgtcatcaatttctaccacctgctctctcttctgcccaaggctgtgttgcttattccttacaaagtttatactgcatttggggctgtatctttttttgttttttgttttgtagaaaataaatatctccgggggcagtacaggtgtctgggcttgtatttgatggggtttctccggtccctgtttctactggatttggagccaggcccagctagccaagtttggaatggcatttgtcatgtcagtagccaccacctttgttcattgtgaacctaccaaggctttccagcttcatacacattgaccagagctcaagctcctgcctgcaactcctgcctagagttgaagaaaagcaaactggccttggcaggcacagtgtcatcataccctcaccccatatgtttggggtctgcttgaggattcataaatcagccactctggattgttgaggaatggccatggcagccacagaaaaaagaatttttctctctgagccaaggttgttttttgtttttttctcttttcttttttgttttcatttcattggaagatctccaatggactgaacagctccagtcagcagcagttaccacaaactgtgaatctgggccccaccactcttccctgttaaccagttctgtcagcatccccctctccagcagcacttccatgaagttggttctgagactctggccgtgaacacccgtttcttcagtgatttgttttgggcttttggctcaaaaccccaggctcttgtttttgtctagactcttattctgtttcctgagcagcaggaggtagggaccactttgatgtcagacttctggtagctggacatgttctcgagatgggtggctgttcgcgacttttgtaccagagtgaaattgttagaaggagggtttctggctgtggttctaaatggagccccaggaagctgccctctccccagggtttgtgctcagtagagccctgtggatcacagtcttgaggtcctctagcaggggtgagggagagcagcgacttcagctgagtccctgccagtggttaagcaaacaatggtttcaaaattcaaggtccccaaatggcagcattttatgttctgacctgtttgtgttatatagtggttttttttttcctctttggaactcttgtgttgttaataaaatgaaatgattactttttaattaaaatgaaaaagtaaaagctttgttcatcttt

SEQ ID NO: 425782 - DNA, 1040 bp, Homo sapiens
cgccggtcggttggtggcgcctttgtcctacggcgggcaggtgggccgacgcggaggcggcagcggcgggcctgaggcgaaggagcggccgggagcccgccgcgctggtagcgatattaataaggcagcggaaagaagaaatatgaatacggctccatcaagacccagccccacacgaagggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggagagaaggctcttatgaccgatacctacgaatggatgactattgcaggagaaaggatgactcttattttgaccgttacagagatagctttgatggacggggccctccaggcccagaaagtcagtctcgtgcaaaaggtaaagtagctgaaacagtctattcctattattgatagaacactttacaaaagagagaggaaactaataaccagtacccccatctgaaaaagggctagtgccttggccaagcagtgtataaaaagaagaaatataagtagcttattagtgggtaaagagcatttggcttgaaaatgatttttaagatgcaaattagtaccatcatctggtttagtcatccaacaagaagaaataaatatgaaattccagcaataagaaatgaacaaaatgctggtcactgtggccaccacctgtaatcctagcactttggaaggccaaggccggcagatcacttgagcccaggagttcgagaccagcttaagcaacatgataaaaccccatctctacaaaaaaaaa

SEQ ID NO: 425783 - DNA, 271 bp, Homo sapiens
gcagcgtgttaaagcattgacgtaattagtttaagacaaattacgtgttaactagaaaacgaagggacatttcttaccaagccgtgacaatgtactaccttaactcaataataaaaattgcccaagtgacagtgtgtctctgctgaatggcttttcttacaccatctggttgtcattgtagtttttgttgttgttgctttcatttgaaatgtgctgatgatcttgtttttattccgtagcattgaacagatgggttgattattcttttcag

SEQ ID NO: 425784 - DNA, 165 bp, Homo sapiens
tctagggattttcgagatcagcgagaccccatgtacgacagatacagagacatgagagactcccgagatcctatgtacaggtacatacgtagttactctgcttgttttttcctgagttctttttatgtatgttctgctaaactaattgaaagctctgtaagagca

SEQ ID NO: 425785 - DNA, 633 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaaggtaatgtggactgtggagctctgtgctggtcactttcaaccctgaacctgatgctacttattttgcagttctaagtgcaaagtcggcctggtggatgcttcccattataatattaaatttgcttcttcgtgaggtcacacctcacatccccagtgtcactttaataactagtgttttttacatggtgggccatgacccattagtggactctgcatttaaaaataaataaataaataaaagaagttattagtgagagtgta

SEQ ID NO: 425786 - DNA, 981 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattca

SEQ ID NO: 425787 - DNA, 495 bp, Homo sapiens
tcagtccctctccacatttttaacccatgcctcgtttctctgaacacacaacacccatcgtcctcttttatgttacttgaaatatcaaaagaattattacagctgaaaacaaatctatgtaaatcggatcttgaaagagagaaagctttctccagttttgaaaggcgccatttttaactttgatcttgtaatgacaaataagaatgttgaatcggctggcttttttctatcctaggtaatgtggactgtggagctctgtgctggtcactttcaaccctgaacctgatgctacttattttgcagttctaagtgcaaagtcggcctggtggatgcttcccattataatattaaatttgcttcttcgtgaggtcacacctcacatccccagtgtcactttaataactagtgttttttacatggtgggccatgacccattagtggactctgcatttaaaaataaataaataaataaaagaagttattagtgagagtgta

SEQ ID NO: 425788 - DNA, 378 bp, Homo sapiens
tgttttgtttttaaacattcaaaagcaattaatgatcagacataggagaaaccctgaatagaaacaaaacttttgaatgctggattcaaaaaaaaaaaaaaagttatctggacagcttctttgagactatttaaaaactggtacaacaggtctctacaacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattca

SEQ ID NO: 425789 - DNA, 4499 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgagggagagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtgatgggggagtgggtattacatgcattgctgaagagtcatcctggtgttcctcattcctcccaccttcccgtggtcattttaattacggggcagtgtcaccgcaaagggaggaaactcaaagccgaaagcaaaattccaggcctgattctggcttttgaggttcctggttcttgaagccaggcctgacccgactctcagatggggtcagtcccgtcgctttgcagactgaccctggaaatctacaaaatgcagattttcctgatttcctcttctcttgcccagtttttttttttttttttttttttttttttaaagcctggattgtaaccagattttcttttttcccccttctcagctgtagatatgatatctcctttcagggccccagcttaagggcaaagtgagttaatgtgtagacaaaggcgagggacaagagagagttaacatctagacagtggaaaaagccatggtgtgtggtttctgggaaccaccaacacttgcaggtttagctttttcccagggttgactacaagaaagaaaaccatgtttttgcaagattaaaatgtggttgagtgtgcctaaattaaccatccccatttttatcatatttccaccatcacttcagggttttaagagtcagtgctcacctgggcggagctgggtagtacattttgcttcttagaaagctaagtcctgggttccgtctgattttaggttccaggaacttcctgagaacacccgatcgcagagggtaattttctggagtttgttttgcagggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425790 - DNA, 4481 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgagggagagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtgatgggggagtgggtattacatgcattgctgaagagtcatcctggtgttcctcattcctcccaccttcccgtggtcattttaattacggggcagtgtcaccgcaaagggaggaaactcaaagccgaaagcaaaattccaggcctgattctggcttttgaggttcctggttcttgaagccaggcctgacccgactctcagatggggtcagtcccgtcgctttgcagactgaccctggaaatctacaaaatgcagattttcctgatttcctcttctcttgcccagtttttttttttttttttttttttttttttaaagcctggattgtaaccagattttcttttttcccccttctcagctgtagatatgatatctcctttcagggccccagcttaagggcaaagtgagttaatgtgtagacaaaggcgagggacaagagagagttaacatctagacagtggaaaaagccatggtgtgtggtttctgggaaccaccaacacttgcaggtttagctttttcccagggttgactacaagaaagaaaaccatgtttttgcaagattaaaatgtggttgagtgtgcctaaattaaccatccccatttttatcatatttccaccatcacttcagggttttaagagtcagtgctcacctgggcggagctgggtagtacattttgcttcttagaaagctaagtcctgggttccgtctgattttaggttccaggaacttcctgagaacacccgatcgcagagggtaattttctggagtttgttttgcagggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425791 - DNA, 4337 bp, Homo sapiens
cttttaaattcaatcagccaccttcatgtgcctttttcctttgtctttccccaaaattccaggaccagagatctggccctggctaattttctcttgctgtgtacacacacgcaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgagggagagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtgatgggggagtgggtattacatgcattgctgaagagtcatcctggtgttcctcattcctcccaccttcccgtggtcattttaattacggggcagtgtcaccgcaaagggaggaaactcaaagccgaaagcaaaattccaggcctgattctggcttttgaggttcctggttcttgaagccaggcctgacccgactctcagatggggtcagtcccgtcgctttgcagactgaccctggaaatctacaaaatgcagattttcctgatttcctcttctcttgcccagtttttttttttttttttttttttttttttaaagcctggattgtaaccagattttcttttttcccccttctcagctgtagatatgatatctcctttcagggccccagcttaagggcaaagtgagttaatgtgtagacaaaggcgagggacaagagagagttaacatctagacagtggaaaaagccatggtgtgtggtttctgggaaccaccaacacttgcaggtttagctttttcccagggttgactacaagaaagaaaaccatgtttttgcaagattaaaatgtggttgagtgtgcctaaattaaccatccccatttttatcatatttccaccatcacttcagggttttaagagtcagtgctcacctgggcggagctgggtagtacattttgcttcttagaaagctaagtcctgggttccgtctgattttaggttccaggaacttcctgagaacacccgatcgcagagggtaattttctggagtttgttttgcagggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425792 - DNA, 3226 bp, Homo sapiens
gtttgcctgtcttttgtctttcaaggtgaagctattaaatttgttctcagctaccctccatgtcctagcagatagaggacttggtctgaccttcagggttgtgatggggcaggttgggaggtgggcggggagtctctgtggtctgggtgctgaggttgacccgatgggcaggtgaagaaaatcaccttctccattccccttgatttctttatcgtgtgccgcacgaggcatgctgaagggacacacacctttccccctttttatttacaaagtagagagctgagaaagacagctcatgttctgttttgttttgtacacattatctttctcaagagatgtgatgtccttaagtaaactgacctgccttcatggcttgtcctgtaatgaatgcgttcaagacagtgttttggggacaggaaagaggcattcttaggtaagcggtggtggggggtggggtggggtggagaggaaacccttctaggaagtagttcaatgaaaaacctaaaaatgcccaaataaacattcgcttacatattatatatcttgggcttctttttatgacagttcattcagggacccagtcagtaaacaggtagttaacttcgtgtaaccaagcaagggttttgtttatcttttttaaagtagaaaaaagtgaggctcaaactctctctttctccttgtcataactattggtttacagtctttatttgtttaaaagtaaagcacattgtatgtatttatttggcaatacatgaggccattaaaaccctgagcctaaggtaccacagttagtctcatttgcctcttgtcctgtgaactccacttagaatgtcattgaacttgggcagacataattctagtgtctgttccaaacgcactgtgtcacagaagctagaattaccattagaggcacaaacccctgagaatacacaagggggcacgcttccagtagatgtgttggggaaggaggagggcagaggggacaggggacaggattcagctttgtggtgggtcctgagggttcctaccaggggtagccaggatctgggaaacagatcagcgactctagtctgaagtggctgcctggttcgggggctgccttcagcaagattcaggcaggagagacggaaatagccaccttccaggcgtgagtcctggagataaaaatggattttaacctaggactgccgggagctggccctccgcggctgctcagactagggctgtgtgtgctggctctcgcctgtttccggtgtctaactggcttgtttctctttatggcttggcttcattccgacctggggtggggccacatccaacccactgcccactggctgtccgtctggcctgccccgcggttccaaccacagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425793 - DNA, 4450 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgagggagagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtgatgggggagtgggtattacatgcattgctgaagagtcatcctggtgttcctcattcctcccaccttcccgtggtcattttaattacggggcagtgtcaccgcaaagggaggaaactcaaagccgaaagcaaaattccaggcctgattctggcttttgaggttcctggttcttgaagccaggcctgacccgactctcagatggggtcagtcccgtcgctttgcagactgaccctggaaatctacaaaatgcagattttcctgatttcctcttctcttgcccagtttttttttttttttttttttttttttttaaagcctggattgtaaccagattttcttttttcccccttctcagctgtagatatgatatctcctttcagggccccagcttaagggcaaagtgagttaatgtgtagacaaaggcgagggacaagagagagttaacatctagacagtggaaaaagccatggtgtgtggtttctgggaaccaccaacacttgcaggtttagctttttcccagggttgactacaagaaagaaaaccatgtttttgcaagattaaaatgtggttgagtgtgcctaaattaaccatccccatttttatcatatttccaccatcacttcagggttttaagagtcagtgctcacctgggcggagctgggtagtacattttgcttcttagaaagctaagtcctgggttccgtctgattctggagtttgttttgcagggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425794 - DNA, 2515 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacgggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425795 - DNA, 2907 bp, Homo sapiens
gggcaattaaagagatttgaatggggctgtatattcaattttatggaattattgatatttttcttaggtatatttcttaatattgtggcaatgtaaaataatatccttattcttggggagaataagctgaagaatttaagggtggagaggaaacccttctaggaagtagttcaatgaaaaacctaaaaatgcccaaataaacattcgcttacatattatatatcttgggcttctttttatgacagttcattcagggacccagtcagtaaacaggtagttaacttcgtgtaaccaagcaagggttttgtttatcttttttaaagtagaaaaaagtgaggctcaaactctctctttctccttgtcataactattggtttacagtctttatttgtttaaaagtaaagcacattgtatgtatttatttggcaatacatgaggccattaaaaccctgagcctaaggtaccacagttagtctcatttgcctcttgtcctgtgaactccacttagaatgtcattgaacttgggcagacataattctagtgtctgttccaaacgcactgtgtcacagaagctagaattaccattagaggcacaaacccctgagaatacacaagggggcacgcttccagtagatgtgttggggaaggaggagggcagaggggacaggggacaggattcagctttgtggtgggtcctgagggttcctaccaggggtagccaggatctgggaaacagatcagcgactctagtctgaagtggctgcctggttcgggggctgccttcagcaagattcaggcaggagagacggaaatagccaccttccaggcgtgagtcctggagataaaaatggattttaacctaggactgccgggagctggccctccgcggctgctcagactagggctgtgtgtgctggctctcgcctgtttccggtgtctaactggcttgtttctctttatggcttggcttcattccgacctggggtggggccacatccaacccactgcccactggctgtccgtctggcctgccccgcggttccaaccacagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425796 - DNA, 3143 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttgggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425797 - DNA, 3118 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaaggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425798 - DNA, 2991 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaagggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425799 - DNA, 4445 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgagggagagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtgatgggggagtgggtattacatgcattgctgaagagtcatcctggtgttcctcattcctcccaccttcccgtggtcattttaattacggggcagtgtcaccgcaaagggaggaaactcaaagccgaaagcaaaattccaggcctgattctggcttttgaggttcctggttcttgaagccaggcctgacccgactctcagatggggtcagtcccgtcgctttgcagactgaccctggaaatctacaaaatgcagattttcctgatttcctcttctcttgcccagtttttttttttttttttttttttttttttaaagcctggattgtaaccagattttcttttttcccccttctcagctgtagatatgatatctcctttcagggccccagcttaagggcaaagtgagttaatgtgtagacaaaggcgagggacaagagagagttaacatctagacagtggaaaaagccatggtgtgtggtttctgggaaccaccaacacttgcaggtttagctttttcccagggttgactacaagaaagaaaaccatgtttttgcaagattaaaatgtggttgagtgtgcctaaattaaccatccccatttttatcatatttccaccatcacttcagggttttaagagtcagtgctcacctgggcggagctgggtagtacattttgcttcttagaaagctaagtcctgggttccgtctgattttaggttccaggaacttcctgagaacacccgatcgcagagggtaattttctggagtttgttttgcagggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggtctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425800 - DNA, 2639 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagagacagggtcttgccttgtcgcctaggctggagtgcagtgttgagatcatagtttactgcagcctcgaactcctgggtacaaggaatcctccctcctcagcctcctgagtagctgggattacagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacgggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425801 - DNA, 2467 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacgggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425802 - DNA, 3214 bp, Homo sapiens
cccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgagggagagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtgatgggggagtgggtattacatgcattgctgaagagtcatcctggtgttcctcattcctcccaccttcccgtggtcattttaattacggggcagtgtcaccgcaaagggaggaaactcaaagccgaaagcaaaattccaggcctgattctggcttttgaggttcctggttcttgaagccaggcctgacccgactctcagatggggtcagtcccgtcgctttgcagactgaccctggaaatctacaaaatgcagattttcctgatttcctcttctcttgcccagtttttttttttttttttttttttttttttaaagcctggattgtaaccagattttcttttttcccccttctcagctgtagatatgatatctcctttcagggccccagcttaagggcaaagtgagttaatgtgtagacaaaggcgagggacaagagagagttaacatctagacagtggaaaaagccatggtgtgtggtttctgggaaccaccaacacttgcaggtttagctttttcccagggttgactacaagaaagaaaaccatgtttttgcaagattaaaatgtggttgagtgtgcctaaattaaccatccccatttttatcatatttccaccatcacttcagggttttaagagtcagtgctcacctgggcggagctgggtagtacattttgcttcttagaaagctaagtcctgggttccgtctgattttaggttccaggaacttcctgagaacacccgatcgcagagggtaattttctggagtttgttttgcagggatagctgggagtatggccaccctgctccacgatgcggtaatgaatccagcagaaggtaatgtttcatggtcccagggaggggcagtaggggatgtgcaaaggggcacaaaaaatggttgtgggagagtggagaggactgaaggtgggcagagcggctcctagtctccagtcagagcagacaggagaattgaattttttactacgttatcaaaggcctcaagaaaggacgtgaacataagagtttttggtattcctgtgctcggagctactcaaagtgtgttctacagaccagcagcatcagacatcttgaggggtgttggaaatgctaattctgaggctgggtgcagtggctcatgcctgtaatcccagcattttttgggaggccgaggtgggcagatcacttgaggtcaggagttcgagaccagcctggccaacatggagagacccccatctctactaaaaatacaaaaattagcctagtgcggtgtgtgcacctgtaatcccagctactggggtggccgaggtgggagaatcgcttgaacccagcaggcagaggttgcagtgcaccgagagtacgccactgtactccagcctgggccacagagccagactccatctcaaaagga

SEQ ID NO: 425803 - DNA, 2787 bp, Homo sapiens
gtttgcctgtcttttgtctttcaaggtgaagctattaaatttgttctcagctaccctccatgtcctagcagatagaggacttggtctgaccttcagggttgtgatggggcaggttgggaggtgggcggggagtctctgtggtctgggtgctgaggttgacccgatgggcaggtgaagaaaatcaccttctccattccccttgatttctttatcgtgtgccgcacgaggcatgctgaagggacacacacctttccccctttttatttacaaagtagagagctgagaaagacagctcatgttctgttttgttttgtacacattatctttctcaagagatgtgatgtccttaagtaaactgacctgccttcatggcttgtcctgtaatgaatgcgttcaagacagtgttttggggacaggaaagaggcattcttaggtaagcggtggtggggggtggggtggggtggagaggaaacccttctaggaagtagttcaatgaaaaacctaaaaatgcccaaataaacattcgcttacatattatatatcttgggcttctttttatgacagttcattcagggacccagtcagtaaacaggtagttaacttcgtgtaaccaagcaagggttttgtttatcttttttaaagtagaaaaaagtgaggctcaaactctctctttctccttgtcataactattggtttacagtctttatttgtttaaaagtaaagcacattgtatgtatttatttggcaatacatgaggccattaaaaccctgagcctaaggtaccacagttagtctcatttgcctcttgtcctgtgaactccacttagaatgtcattgaacttgggcagacataattctagtgtctgttccaaacgcactgtgtcacagaagctagaattaccattagaggcacaaacccctgagaatacacaagggggcacgcttccagtagatgtgttggggaaggaggagggcagaggggacaggggacaggattcagctttgtggtgggtcctgagggttcctaccaggggtagccaggatctgggaaacagatcagcgactctagtctgaagtggctgcctggttcgggggctgccttcagcaagattcaggcaggagagacggaaatagccaccttccaggcgtgagtcctggagataaaaatggattttaacctaggactgccgggagctggccctccgcggctgctcagactagggctgtgtgtgctggctctcgcctgtttccggtgtctaactggcttgtttctctttatggcttggcttcattccgacctggggtggggccacatccaacccactgcccactggctgtccgtctggcctgccccgcggttccaaccacagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagtttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcg

SEQ ID NO: 425804 - DNA, 1594 bp, Homo sapiens
gtttgcctgtcttttgtctttcaaggtgaagctattaaatttgttctcagctaccctccatgtcctagcagatagaggacttggtctgaccttcagggttgtgatggggcaggttgggaggtgggcggggagtctctgtggtctgggtgctgaggttgacccgatgggcaggtgaagaaaatcaccttctccattccccttgatttctttatcgtgtgccgcacgaggcatgctgaagggacacacacctttccccctttttatttacaaagtagagagctgagaaagacagctcatgttctgttttgttttgtacacattatctttctcaagagatgtgatgtccttaagtaaactgacctgccttcatggcttgtcctgtaatgaatgcgttcaagacagtgttttggggacaggaaagaggcattcttaggtaagcggtggtggggggtggggtggggtggagaggaaacccttctaggaagtagttcaatgaaaaacctaaaaatgcccaaataaacattcgcttacatattatatatcttgggcttctttttatgacagttcattcagggacccagtcagtaaacaggtagttaacttcgtgtaaccaagcaagggttttgtttatcttttttaaagtagaaaaaagtgaggctcaaactctctctttctccttgtcataactattggtttacagtctttatttgtttaaaagtaaagcacattgtatgtatttatttggcaatacatgaggccattaaaaccctgagcctaaggtaccacagttagtctcatttgcctcttgtcctgtgaactccacttagaatgtcattgaacttgggcagacataattctagtgtctgttccaaacgcactgtgtcacagaagctagaattaccattagaggcacaaacccctgagaatacacaagggggcacgcttccagtagatgtgttggggaaggaggagggcagaggggacaggggacaggattcagctttgtggtgggtcctgagggttcctaccaggggtagccaggatctgggaaacagatcagcgactctagtctgaagtggctgcctggttcgggggctgccttcagcaagattcaggcaggagagacggaaatagccaccttccaggcgtgagtcctggagataaaaatggattttaacctaggactgccgggagctggccctccgcggctgctcagactagggctgtgtgtgctggctctcgcctgtttccggtgtctaactggcttgtttctctttatggcttggcttcattccgacctggggtggggccacatccaacccactgcccactggctgtccgtctggcctgccccgcggttccaaccacagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagacactccccccccaactatacacacgccgcgttttcataaattattggttttcaacgaaa

SEQ ID NO: 425805 - DNA, 805 bp, Homo sapiens
cgcgctcgcgcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccggtgagtgatgaagcactgggactgcgcgtggtgtaaagcacggagtcagttcctactgactgtcacgtggcagagtccagtccaaaagcttgttgatgaaagagtggttcaaaactcagaatgtggccgggcacattggctcacacctgtgatcccagcattttaggaggccgaggcaggaggatcacttgagcctgggagttcaagaccagcctgggcagcagagcaagaccctgtctcatttgaaaaataaataaataaagaaaaaaaaaaagaattcagattat

SEQ ID NO: 425806 - DNA, 494 bp, Homo sapiens
cgagtgctacccgtctccgatcgtaacaggcgctcagtcctaacagaggccggggagtgccagaagacctagggagccagcggtcaagtccccaagtttgtcaagtgtccaagttcaccaagggaatggaagactaagagatgggctgggcaccgtggctcacgcctgtattctcaacacttgggaaggccacggcggggggatcacttgaggccaggagttcaagaccagcctcccaaagtgctaggattatacgcgcctggcctcagaggctatactcttataattttgttctgaggggagacagggaaagggttagacaacttgaaacattgaccctgtataaaaatgcaaaattctcaatgtgtatttataaatttctattttttataactttatgggacttcttagaggccaaaagtagtaaacatgcagattaaaaatgtttatgaaaatctcaataaaaattcataataaaaactttgtaaataaat

SEQ ID NO: 425807 - DNA, 1372 bp, Homo sapiens
  misc_feature (1332)..(1332): n is a, c, g, or t
tgctgagattacaggcgtgagccaccgcaccccaccagagactttcttaatcaatcaggctatgtggtggggcatagcagcagccagtgacttcgttcattatcacaggatttgattcctttgaaactcaagagaccagggaaagtgacaggaaggaaagggctctttgctgctgtgcttattacaaagaagactgtttgtccagcgtgtatttcaggatatctggatcccttttattgactcacaatttgtggcaccactttctcatcccagaacttcattcttatttctctcctcatctggcctcccaagtgctccgttgagctgatgaaaagttctttgtactccctcaacgtgtcggaaacaggaggccacacagcacagctttgtttggggtgggcaggagtcaggagtcttgagcagatgcatcactgtgaagaagaacgacatgtcggggctgcacctgtcctcccgtcggcatttgacgaaagctccctgaagcggggcagcactctcctcctgagagatttaccatttattgcccctgtgaggaatgtgtgcttgggaactgccaagtcttaccccttctggaagaagaggttttctctgacaagagcctagagcgtcggctctattatgctgggacttgacagaggagccatggggtttaaacagtaggaaagaggagtgagccacggtgcccagcccatctcttagtcttccattcccttggtgaatttggaaacttgaaaaacttggggacttgacagcaggctccatgttcttctggcctcactgtactgtgtaaggaaagagctgcttgtcaggaacggaagaggggacgctagtaaaaaaaaaaaaattggattccccaactggactaaataggagtttttcaggtttgtagtaacgtgaaactctcctagatcgaagcagttagactggcctatgtggccttctcagggtttgtgattcagttcttagcgattcttggcctgataagtttatgaacacagccccacattcaagccgtggccaatcccagctgttctcactgctcttgggaggtgttgtcccagtcagtgtttctgcagcttccatttgttgtttttatccagtgtaagcacctgttgaatgcagatgtgctgagttagaggtgggatttggaaaagggctgctatttctgctgttgagatttcaggcgtgagccacggtgcccagcccatctcttagtcttccattcccttggtgaatttggaaacttgaaaaacttggggacttgacagcaggctccatgttcttctggcctcactgtactgtgtaaggaaaganctgcttgtcaggaacggaagaggggacgctagtataaaaa

SEQ ID NO: 425808 - DNA, 1007 bp, Homo sapiens
tgctgagattacaggcgtgagccaccgcaccccaccagagactttcttaatcaatcaggctatgtggtggggcatagcagcagccagtgacttcgttcattatcacaggatttgattcctttgaaactcaagagaccagggaaagtgacaggaaggaaagggctctttgctgctgtgcttattacaaagaagactgtttgtccagcgtgtatttcaggatatctggatcccttttattgactcacaatttgtggcaccactttctcatcccagaacttcattcttatttctctcctcatctggcctcccaagtgctccgttgagctgatgaaaagttctttgtactccctcaacgtgtcggaaacaggaggccacacagcacagctttgtttggggtgggcaggagtcaggagtcttgagcagatgcatcactgtgaagaagaacgacatgtcggggctgcacctgtcctcccgtcggcatttgacgaaagctccctgaagcggggcagcactctcctcctgagagatttaccatttattgcccctgtgaggaatgtgtgcttgggaactgccaagtcttaccccttctggaagaagaggttttctctgacaagagcctagagcgtcggctctattatgctgggacttgacagaggagccatggggtttaaacagtaggaaagaggagggtggtctcgaacacctgacctcagatgatccacccacctcggcctcccagtgtgggtgggattacaggcatgagccaccgcgcctggcctcagaggctatactcttataattttgttctgaggggagacagggaaagggttagacaacttgaaacattgaccctgtataaaaatgcaaaattctcaatgtgtatttataaatttctattttttataactttatgggacttcttagaggccaaaagtagtaaacatgcagattaaaaatgtttatgaaaatctcaataaaaattcataataaaaactttgtaaataaat

SEQ ID NO: 425809 - DNA, 1283 bp, Homo sapiens
  misc_feature (1243)..(1243): n is a, c, g, or t
tgctgagattacaggcgtgagccaccgcaccccaccagagactttcttaatcaatcaggctatgtggtggggcatagcagcagccagtgacttcgttcattatcacaggatttgattcctttgaaactcaagagaccagggaaagtgacaggaaggaaagggctctttgctgctgtgcttattacaaagaagactgtttgtccagcgtgtatttcaggatatctggatcccttttattgactcacaatttgtggcaccactttctcatcccagaacttcattcttatttctctcctcatctggcctcccaagtgctccgttgagctgatgaaaagttctttgtactccctcaacgtgtcggaaacaggaggccacacagcacagctttgtttggggtgggcaggagtcaggagtcttgagcagatgcatcactgtgaagaagaacgacatgtcggggctgcacctgtcctcccgtcggcatttgacgaaagctccctgaagcggggcagcactctcctcctgagagatttaccatttattgctcctggcctcaagtgatccacccgccttggccttccaaagtgttgagattacaggcgtgagccacggtgcccagcccatctcttagtcttccattcccttggtgaatttggaaacttgaaaaacttggggacttgacagcaggctccatgttcttctggcctcactgtactgtgtaaggaaagagctgcttgtcaggaacggaagaggggacgctagtaaaaaaaaaaaaattggattccccaactggactaaataggagtttttcaggtttgtagtaacgtgaaactctcctagatcgaagcagttagactggcctatgtggccttctcagggtttgtgattcagttcttagcgattcttggcctgataagtttatgaacacagccccacattcaagccgtggccaatcccagctgttctcactgctcttgggaggtgttgtcccagtcagtgtttctgcagcttccatttgttgtttttatccagtgtaagcacctgttgaatgcagatgtgctgagttagaggtgggatttggaaaagggctgctatttctgctgttgagatttcaggcgtgagccacggtgcccagcccatctcttagtcttccattcccttggtgaatttggaaacttgaaaaacttggggacttgacagcaggctccatgttcttctggcctcactgtactgtgtaaggaaaganctgcttgtcaggaacggaagaggggacgctagtataaaaa

SEQ ID NO: 425810 - DNA, 1555 bp, Homo sapiens
cgcgctcgcgcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccggtacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagacagattcctcggagcaggatgaacagacagacacagagaaccttgctcttcatatcagcatggaggattctggagccgagaaggagaacacctctgtcctgcagcagaacccctccttgtcgggtagccggaatggggaggagaacatcatcgataacccttatctgcggccggtgaagaagcccaagatccgcaggaagaagtccctctcctgagctgagaaggaaacctggcttgtacaggggcgcagattccaccctcccggggagttaaagccactcaagggaagaagagggtgacctcctcatggccaagccgaggctgcagggtgtgatcggacatgattttcatggcaaaccgtcttattaagatgacctattttcactggatgtttgggttgaggaagatatgaacagaataatgagaatttttttttttattttgagatggagtcttactctgtcacccaggctggagtgcagtggtgtgatctcggctcactgcagtctcagcaaccctgggtccaagtgattctcctgccttggcctcccgagtagctgggactagaggcaagcgccaccatgctggctaatttttgtattttgagtagagatagggtttcgccatgttggccaggctggtcttgaactcctgacctcagtgatccacccgcattggcctcccaaagagttgcgattacaggtgtgagccaccacgcccggcctggatataccttttttttttttaaatattgaattattcctttcagaattagggctgggagaccatggctttaaataaagcag

SEQ ID NO: 425811 - DNA, 1677 bp, Homo sapiens
cgcgctcgcgcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccggtacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagacagattcctcggagcaggatgaacagacagacacagagaaccttgctcttcatatcagcatgatagagtctcgctccgtcacccaggctggagtgcagtggcaagatcttggctcactgcaacctccgcctcctgggttcaagcgattctccagcctcagcctcctgagtagctggaattacaggaggattctggagccgagaaggagaacacctctgtcctgcagcagaacccctccttgtcgggtagccggaatggggaggagaacatcatcgataacccttatctgcggccggtgaagaagcccaagatccgcaggaagaagtccctctcctgagctgagaaggaaacctggcttgtacaggggcgcagattccaccctcccggggagttaaagccactcaagggaagaagagggtgacctcctcatggccaagccgaggctgcagggtgtgatcggacatgattttcatggcaaaccgtcttattaagatgacctattttcactggatgtttgggttgaggaagatatgaacagaataatgagaatttttttttttattttgagatggagtcttactctgtcacccaggctggagtgcagtggtgtgatctcggctcactgcagtctcagcaaccctgggtccaagtgattctcctgccttggcctcccgagtagctgggactagaggcaagcgccaccatgctggctaatttttgtattttgagtagagatagggtttcgccatgttggccaggctggtcttgaactcctgacctcagtgatccacccgcattggcctcccaaagagttgcgattacaggtgtgagccaccacgcccggcctggatataccttttttttttttaaatattgaattattcctttcagaattagggctgggagaccatggctttaaataaagcag

SEQ ID NO: 425812 - DNA, 931 bp, Homo sapiens
  misc_feature (891)..(891): n is a, c, g, or t
acgctgtgttaagaattgacttccatcataaatgtagcagcaggaagaccaggcagaaggcaaaaaaatgatagtggcttggactaactgtgtgacagttgaggaggtaagagataatcaggggccaggtgtggtggttcgcgcctgtaatcccagcagtttgggagaccaaagtgggctggtcttgagctcctggcctcaagtgatccacccgccttggccttccaaagtgttgagattacaggcgtgagccacggtgcccagcccatctcttagtcttccattcccttggtgaatttggaaacttgaaaaacttggggacttgacagcaggctccatgttcttctggcctcactgtactgtgtaaggaaagagctgcttgtcaggaacggaagaggggacgctagtaaaaaaaaaaaaattggattccccaactggactaaataggagtttttcaggtttgtagtaacgtgaaactctcctagatcgaagcagttagactggcctatgtggccttctcagggtttgtgattcagttcttagcgattcttggcctgataagtttatgaacacagccccacattcaagccgtggccaatcccagctgttctcactgctcttgggaggtgttgtcccagtcagtgtttctgcagcttccatttgttgtttttatccagtgtaagcacctgttgaatgcagatgtgctgagttagaggtgggatttggaaaagggctgctatttctgctgttgagatttcaggcgtgagccacggtgcccagcccatctcttagtcttccattcccttggtgaatttggaaacttgaaaaacttggggacttgacagcaggctccatgttcttctggcctcactgtactgtgtaaggaaaganctgcttgtcaggaacggaagaggggacgctagtataaaaa

SEQ ID NO: 425813 - DNA, 1204 bp, Homo sapiens
  misc_feature (1164)..(1164): n is a, c, g, or t
cgcgctcgcgcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccggttgagccacggtgcccagcccatctcttagtcttccattcccttggtgaatttggaaacttgaaaaacttggggacttgacagcaggctccatgttcttctggcctcactgtactgtgtaaggaaagagctgcttgtcaggaacggaagaggggacgctagtaaaaaaaaaaaaattggattccccaactggactaaataggagtttttcaggtttgtagtaacgtgaaactctcctagatcgaagcagttagactggcctatgtggccttctcagggtttgtgattcagttcttagcgattcttggcctgataagtttatgaacacagccccacattcaagccgtggccaatcccagctgttctcactgctcttgggaggtgttgtcccagtcagtgtttctgcagcttccatttgttgtttttatccagtgtaagcacctgttgaatgcagatgtgctgagttagaggtgggatttggaaaagggctgctatttctgctgttgagatttcaggcgtgagccacggtgcccagcccatctcttagtcttccattcccttggtgaatttggaaacttgaaaaacttggggacttgacagcaggctccatgttcttctggcctcactgtactgtgtaaggaaaganctgcttgtcaggaacggaagaggggacgctagtataaaaa

SEQ ID NO: 425814 - DNA, 1096 bp, Homo sapiens
cactgatttgttgtgaggctctaggactctaagccagctgcgaggtctctgtgacagtggactcatgcctctcttccaattcgccagtgattgctgccagacctttcaccatcccctacctgacagctcttcttccgtctgaactggagatgcaacaaatggaagagacagattcctcggagcaggatgaacagacagacacagagaaccttgctcttcatatcagcatgatagagtctcgctccgtcacccaggctggagtgcagtggcaagatcttggctcactgcaacctccgcctcctgggttcaagcgattctccagcctcagcctcctgagtagctggaattacaggaggattctggagccgagaaggagaacacctctgtcctgcagcagaacccctccttgtcgggtagccggaatggggaggagaacatcatcgataacccttatctgcggccggtgaagaagcccaagatccgcaggaagaagtccctctcctgagctgagaaggaaacctggcttgtacaggggcgcagattccaccctcccggggagttaaagccactcaagggaagaagagggtgacctcctcatggccaagccgaggctgcagggtgtgatcggacatgattttcatggcaaaccgtcttattaagatgacctattttcactggatgtttgggttgaggaagatatgaacagaataatgagaatttttttttttattttgagatggagtcttactctgtcacccaggctggagtgcagtggtgtgatctcggctcactgcagtctcagcaaccctgggtccaagtgattctcctgccttggcctcccgagtagctgggactagaggcaagcgccaccatgctggctaatttttgtattttgagtagagatagggtttcgccatgttggccaggctggtcttgaactcctgacctcagtgatccacccgcattggcctcccaaagagttgcgattacaggtgtgagccaccacgcccggcctggatataccttttttttttttaaatattgaattattcctttcagaattagggctgggagaccatggctttaaataaagcag

SEQ ID NO: 425815 - DNA, 524 bp, Homo sapiens
tatttttaatagagataaggtttcgccatgttggccaggctggtcttgaactcctgacctcaagtgataacccgcctcggcctcccaaagtgctgagattacaggcgtgagccaccgcaccccaccagagactttcttaatcaatcaggctatgtggtggggcatagcagcagccagtgacttcgttcattatcacaggatttgattcctttgaaactcaagagaccagggaaagtgacaggaaggaaagggctctttgctgctgtgcttattacaaagaagactgtttgtccagcgtgtatttcaggatatctggatcccttttattgactcacaatttgtggcaccactttctcatcccagaacttcattcttatttctctcctcatctggcctcccaagtgctccgttgagctgatgaaaagttctttgtactccctcaacgtgtcggaaacaggaggccacacagcacagctttgtttggggtgggcaggagtcaggagtcttgagcagatgcatcactg

SEQ ID NO: 425816 - DNA, 479 bp, Homo sapiens
tgttcttctggcctcactgtactgtgtaaggaaagagctgcttgtcaggaacggaagaggggacgctagtaaaaaaaaaaaaattggattccccaactggactaaataggagtttttcaggtttgtagtaacgtgaaactctcctagatcgaagcagttagactggcctatgtggccttctcagggtttgtgattcagttcttagcgattcttggcctgataagtttatgaacacagccccacattcaagccgtggccaatcccagctgttctcactgctcttgggaggtgttgtcccagtcagtgtttctgcagcttccatttgttgtttttatccagtgtaagcacctgttgaatgcagatgtgctgagttagaggtgggatttggaaaagggctgctatttctgctgttgagatttcagaggctatactctttttttttcttttcttttttttttttttttgagacggcatctcac

SEQ ID NO: 425817 - DNA, 3555 bp, Homo sapiens
cgcgcctccgcccctcgctcgctcgctccttcccgccctccccgcagcgccggccgagccggcttcccctcagtctctcatgaatattgagcggcccctgttgtatttcccgagctccattgcggaagctgaggctcgccatattgtgcggcggcgccggcgtccgcggcagctgataccagagtcttgctccggccgcggccagcggagccctgggctggggcaggagccgcaatgtctcaggctgtgcagacaaacggaactcaaccattaagcaaaacatgggaactcagtttatatgagttacaacgaacacctcaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtggcaacaaagaatgtcctacctgtcggaaaaaactagtttccaaaagatcactaaggccagacccaaactttgatgcactcatcagcaaaatttatccaagtcgtgatgagtatgaagctcatcaagagagagtattagccaggatcaacaagcacaataatcagcaagcactcagtcacagcattgaggaaggactgaagatacaggccatgaacagactgcagcgaggcaagaaacaacagattgaaaatggtagtggagcagaagataatggtgacagttcacactgcagtaatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgagatacataaagacttctggtaacgccactgttgatcacttatccaagtatctggctgtgaggttagctttagaagaacttcgaagcaaaggtgaatcaaaccagatgaaccttgatacagccagtgagaagcagtataccatttatatagcaacagccagtggccagttcactgtattaaatggctctttttctttggaattggtcagtgagaaatactggaaagtgaacaaacccatggaactttattacgcacctacaaaggagcacaaatgagcctttaaaaaccaattctgagactgaacttttttatagcctatttctttaatattaaagatgtactggcattacttttatggacagatcttggatatgttgttcaattttctttctgagccagactagtttacgctattcaaatcttttcccctttatttaagatttcctttttggaagggactgcaattattcagtatttttttctttcctttaaaaaaatatatctgaagtttcttgtgtttttttttttccccacaaagtgtgtttccacttggagcaccattttgacccaggaatttttcatagtttctgtattcttataagattcagttggctgtccttttcctgctcccctcaaaagatttttagtcatacagaatgttaaatattatgtattctgactttttttttcccccggagtcttgtatatttatagttttctatataaactgtagtatcttcatgaagacccaaggctcaaatttactgtccttaaaaacaattctcataggattattcttttcatggtattttcttccataatatctcattttaaaaagaagttctttatgaacttagtgtccattgtcatgcaatgtttttttttttccattctttttccctgtaattttggaatttctggtcctgggaagaatcaaacaaaatcttaagttctatgagaacttggttcattgacatattctgctgaagaaagaaaaattaaattggtagtaaaatatagtcttcaagtatacgtttgagagtgcttttttttgtattagttctgctgtcacttcatttcctgtattatatgtgatgtttttccccattaaaataccagagataatggagatattttgcactttagccttgatgaaaagtacaagatatgttcaaagcttccctaatttttttcttatttgtagccacataagtttcaagaataacatggcacacagaacaatggaaaaaagtttgtttccattggaaaattatatcattttgggttgccacatcagtttataaatttggcgctcttttaattacactctgtagaaggttaatagagcttgagccctgctttaatatgtagtgaaagataattctgtagaaaaacgtcagccagtagggtaaagtcattctactgttcttaatttttatattgaggaacaatattgggtgtttgggagccagaaagctttgttgacagatcagaaataagattgacttgggtgttatatttcatctctctccagactctaggtatatttccaactttatatatcacagtatttaaaaagacatgtttgcattgagaaattaaccctaaagggttttcaatagggtgtagacctccagtacctttgtaactaaagtctgtctagtcattgtaaatatttatctgtcagttttgacagattggggccagcttgatgttttaaatcttcagcccggtatgaaaacttaaaggtatatattcaattttttaccattttatggaaaatatttaaaatctgtttttacagggtttttttttttttttttttttttttgtaatctgtgccatgaaatttgaaaaccaccaaaaatcaagggaacttttatatattcaattccttttctggtgtaatgttaaagttgtatagattattaatgcatgcccactgaatataaccctggttttgtgataaaactgcttagattttgttgatgacattagattagtagttgcattaaataactaaattcccattgtgattaattgaaattttgtctttaagcagagagttatttgtgactataagctttgtgcttagagaatgtatgtgtttttatctgtcagtatgggaggatataaactgcatcattagtgaaattattggttgtgtaatcctttgtgaaatataattctaggtatttgatagggtattgagtgtattttgtgtgtgtgtggatgtgtgttttggggtacggggagaggcgatgctattggccatcactaccaaccagggtttcaaaaagtattacctaagtaatttcttttatcactatctcaactgaggaagaaaaggctcaccacaagtggtgtgaaggctttgggtacttagttctaaatttttttatggtaacatatacatagccacatttacagttttaaccattttaaggcatgtaattcagtggggttaggtacattcacaatgttgtgtaatgatcaccgctgtctacttgtaaaactttttcatcaccccaaacagaaactctgtgtgcaattaaagtaatgcatttctcttcttcttaacccct

SEQ ID NO: 425818 - DNA, 1999 bp, Homo sapiens
cgcgcctccgcccctcgctcgctcgctccttcccgccctccccgcagcgccggccgagccggcttcccctcagtctctcatgaatattgagcggcccctgttgtatttcccgagctccattgcggaagctgaggctcgccatattgtgcggcggcgccggcgtccgcggcagctgataccagagtcttgctccggccgcggccagcggagccctgggctggggcaggagccgcaatgtctcaggctgtgcagacaaacggaactcaaccattaagcaaaacatgggaactcagtttatatgagttacaacgaacacctcaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtggcaacaaagaatgtcctacctgtcggaaaaaactagtttccaaaagatcactaaggccagacccaaactttgatgcactcatcagcaaaatttatccaagtcgtgatgagtatgaagctcatcaagagagagtattagccaggatcaacaagcacaataatcagcaagcactcagtcacagcattgaggaaggactgaagatacaggccatgaacagactgcagcgaggcaagaaacaacagattgaaaatggtagtggagcagaagataatggtgacagttcacactgcagtaatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgagatacataaagacttctggtaacgccactgttgatcacttatccaagtatctggctgtgaggttagctttagaagaacttcgaagcaaaggtgaatcaaaccagatgaaccttgatacagccagtgagaagcagtataccatttatatagcaacagccagtggccagttcactgtattaaatggctctttttctttggaattggtcagtgagaaatactggaaagtgaacaaacccatggaactttattacgcacctacaaaggagcacaaatgagcctttaaaaaccaattctgagactgaacttttttatagcctatttctttaatattaaagatgtactggcattacttttatggacagatcttggatatgttgttcaattttctttctgagccagactagtttacgctattcaaatcttttcccctttatttaagatttcctttttggaagggactgcaattattcagtatttttttctttcctttaaaaaaatatatctgaagtttcttgtgtttttttttttccccacaaagtgtgtttccacttggagcaccattttgacccaggaatttttcatagtttctgtattcttataagattcagttggctgtccttttcctgctcccctcaaaagatttttagtcatacagaatgttaaatattatgtattctgactttttttttcccccggagtcttgtatatttatagttttctatataaactgtagtatcttcatgaagacccaaggctcaaatttactgtccttaaaaacaattctcataggattattcttttcatggtattttcttccataatatctcattttaaaaagaagttctttatgaacttagtgtccattgtcatgcaatgtttttttttttccattctttttccctgtaattttggaatttctggtcctgggaagaatcaaacaaaatcttaagttctatgagaacttggttcattgacatattctgctgaagaaagaaaaattaaattggtagtaaaatatagtcttcaagt

SEQ ID NO: 425819 - DNA, 388 bp, Homo sapiens
ttgcctgtgagcaagagagattttttagacctttcaggaacatgtgggaaacaatatcatccaactcagagtaaattcagttaccagtattttttggaattctaaagttcagtagcaaacatgcttcagatttgttgctttaaaggcctaaaagtaaattttatgcatccttttttcccccttgactagactgcagcgaggcaagaaacaacagattgaaaatggtagtggagcagaagataatggtgacagttcacactgcagtaatgcatccacacatagcaatcaggaagcaggccctagtaacaaacggaccaaataattcaagcactgcttattacaattttactgggcaggcacggtggttcacacctgtaaacccaacaca

SEQ ID NO: 425820 - DNA, 3516 bp, Homo sapiens
tgtctgcatcgtgggggtggggtagggggcactttgtgcagatatcgctccttccttctggggggtcggagtcggggttccagtgtagaggagctcctcgacctcggggttcctcggggagaccccttcagcttcacacattcctggagtgccgcctcctgctctggagtatctgttgctgctttctaaaacccaatgtctcaggctgtgcagacaaacggaactcaaccattaagcaaaacatgggaactcagtttatatgagttacaacgaacacctcaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtggcaacaaagaatgtcctacctgtcggaaaaaactagtttccaaaagatcactaaggccagacccaaactttgatgcactcatcagcaaaatttatccaagtcgtgatgagtatgaagctcatcaagagagagtattagccaggatcaacaagcacaataatcagcaagcactcagtcacagcattgaggaaggactgaagatacaggccatgaacagactgcagcgaggcaagaaacaacagattgaaaatggtagtggagcagaagataatggtgacagttcacactgcagtaatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgagatacataaagacttctggtaacgccactgttgatcacttatccaagtatctggctgtgaggttagctttagaagaacttcgaagcaaaggtgaatcaaaccagatgaaccttgatacagccagtgagaagcagtataccatttatatagcaacagccagtggccagttcactgtattaaatggctctttttctttggaattggtcagtgagaaatactggaaagtgaacaaacccatggaactttattacgcacctacaaaggagcacaaatgagcctttaaaaaccaattctgagactgaacttttttatagcctatttctttaatattaaagatgtactggcattacttttatggacagatcttggatatgttgttcaattttctttctgagccagactagtttacgctattcaaatcttttcccctttatttaagatttcctttttggaagggactgcaattattcagtatttttttctttcctttaaaaaaatatatctgaagtttcttgtgtttttttttttccccacaaagtgtgtttccacttggagcaccattttgacccaggaatttttcatagtttctgtattcttataagattcagttggctgtccttttcctgctcccctcaaaagatttttagtcatacagaatgttaaatattatgtattctgactttttttttcccccggagtcttgtatatttatagttttctatataaactgtagtatcttcatgaagacccaaggctcaaatttactgtccttaaaaacaattctcataggattattcttttcatggtattttcttccataatatctcattttaaaaagaagttctttatgaacttagtgtccattgtcatgcaatgtttttttttttccattctttttccctgtaattttggaatttctggtcctgggaagaatcaaacaaaatcttaagttctatgagaacttggttcattgacatattctgctgaagaaagaaaaattaaattggtagtaaaatatagtcttcaagtatacgtttgagagtgcttttttttgtattagttctgctgtcacttcatttcctgtattatatgtgatgtttttccccattaaaataccagagataatggagatattttgcactttagccttgatgaaaagtacaagatatgttcaaagcttccctaatttttttcttatttgtagccacataagtttcaagaataacatggcacacagaacaatggaaaaaagtttgtttccattggaaaattatatcattttgggttgccacatcagtttataaatttggcgctcttttaattacactctgtagaaggttaatagagcttgagccctgctttaatatgtagtgaaagataattctgtagaaaaacgtcagccagtagggtaaagtcattctactgttcttaatttttatattgaggaacaatattgggtgtttgggagccagaaagctttgttgacagatcagaaataagattgacttgggtgttatatttcatctctctccagactctaggtatatttccaactttatatatcacagtatttaaaaagacatgtttgcattgagaaattaaccctaaagggttttcaatagggtgtagacctccagtacctttgtaactaaagtctgtctagtcattgtaaatatttatctgtcagttttgacagattggggccagcttgatgttttaaatcttcagcccggtatgaaaacttaaaggtatatattcaattttttaccattttatggaaaatatttaaaatctgtttttacagggtttttttttttttttttttttttttgtaatctgtgccatgaaatttgaaaaccaccaaaaatcaagggaacttttatatattcaattccttttctggtgtaatgttaaagttgtatagattattaatgcatgcccactgaatataaccctggttttgtgataaaactgcttagattttgttgatgacattagattagtagttgcattaaataactaaattcccattgtgattaattgaaattttgtctttaagcagagagttatttgtgactataagctttgtgcttagagaatgtatgtgtttttatctgtcagtatgggaggatataaactgcatcattagtgaaattattggttgtgtaatcctttgtgaaatataattctaggtatttgatagggtattgagtgtattttgtgtgtgtgtggatgtgtgttttggggtacggggagaggcgatgctattggccatcactaccaaccagggtttcaaaaagtattacctaagtaatttcttttatcactatctcaactgaggaagaaaaggctcaccacaagtggtgtgaaggctttgggtacttagttctaaatttttttatggtaacatatacatagccacatttacagttttaaccattttaaggcatgtaattcagtggggttaggtacattcacaatgttgtgtaatgatcaccgctgtctacttgtaaaactttttcatcaccccaaacagaaactctgtgtgcaattaaagtaatgcatttctcttcttcttaacccct

SEQ ID NO: 425821 - DNA, 576 bp, Homo sapiens
actgttgatcacttatccaagtatctggctgtgaggttagctttagaagaacttcgaagcaaaggtgaatcaaaccagatgaaccttgatacagccagtgagaagcagtataccatttatatagcaacagccagtggccagttcactgtgagtatttaaaataatagactgttgaaactgggagcacactgaccaactaactgagtggcaagtggtggggtagaatctaataaataatgtaaaaaaccgtaacagtgttaagtgacaagtagttattcctaagatttgaaaaaaaaagattctgtggacttccattttagtttcatttcattattattgtggtttgtgcagttttcataattttttctttcttttttgttttaggtattaaatggctctttttctttggaattggtcagtgagaaatactggaaagtgaacaaacccatggaactttattacgcacctacaaaggagcacaaatgagcctttaaaaaccaattctgagactgaacttttttatagcctatttctttaatattaaagatgtactggcattacttttatggacagatc

SEQ ID NO: 425822 - DNA, 1833 bp, Homo sapiens
accacaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctca

SEQ ID NO: 425823 - DNA, 1904 bp, Homo sapiens
accacaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaaga

SEQ ID NO: 425824 - DNA, 1298 bp, Homo sapiens
tcccaccaggccccacctccaacattgaggattacaattcaacatcacatctgggcagggacaaatacccactttatatcagaaggcatcaacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatg

SEQ ID NO: 425825 - DNA, 795 bp, Homo sapiens
accacaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaagtcaaagttcctgtcttattaattaagcattttcttggaggtagaatgttctacagcaaataaataggcacagagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggttaggagctatggagtaggatcatgaggtgggtcgagagtaccttagaaaacataatacataaag

SEQ ID NO: 425826 - DNA, 871 bp, Homo sapiens
accacaaggggcggtccccggtgtcctgcgcgggggcgcggagggggcgggcgtcagttccgcggggggctgtcggggaaccatggctgccccgagagaaaaatttgctgatccctgtttaaccttgagcctaaagatttgaatggagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaagtcaaagttcctgtcttattaattaagcattttcttggaggtagaatgttctacagcaaataaataggcacagagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcagagtatatccgaaaaagttacagagttcagatacttctcttggattgtattctctctggatccaagtcctgtaagtgttcggggctctacact

SEQ ID NO: 425827 - DNA, 2437 bp, Homo sapiens
accacaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaagaaaaattgtttaatcactttatattatagatatgaccattaagataatgcacttttattttctatatgtagaaatgcacttttattttctatatgtggaagtctatcggttagggttctctggctgcaaatcaactcaactctggcaagccttaagcaaaaaagaaagaatttttaagaaggtccacaatcagggctacaggcgtctaggttctaagaattaatggacagttgtcttttcagcttttgtaaagatctggctttacctattactgttcctgtatggtttcactcacgattcaaatactcgggaagacactactgatcttggaaggggaaagtttcttcaaacaagtagagagggatattggatgtgtaaaacatgtccctactttatatttttatcccatggctggtttatgctaagaaaaatgtgacactactttaagtcgaaaattagctatctgggagctaattcacttaaattggaactgcaaggctgaatcttttctaggactaagaaggtaagccatag

SEQ ID NO: 425828 - DNA, 2000 bp, Homo sapiens
accacaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctgtaaagtatggcatctctggggatgaaaattgcctcaccattatgtaatgtttcatttatttgagtgataagattttatttctctctgtatacaagttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaaga

SEQ ID NO: 425829 - DNA, 2440 bp, Homo sapiens
atcgttgatgtagcactccagctcccctttccaatgaagctattctgcagagtcctaggttcctactgttgtgatgagagattggtctcgtctacagtgcctttctgtatgtgagccaaatagtagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaagtcaaagttcctgtcttattaattaagcattttcttggaggtagaatgttctacagcaaataaataggcacagagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaaga

SEQ ID NO: 425830 - DNA, 1949 bp, Homo sapiens
accacaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaagaaaaacagatttgggggaaaaagatatcaacagtttgattttggagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaaga

SEQ ID NO: 425831 - DNA, 1372 bp, Homo sapiens
accacaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatg

SEQ ID NO: 425832 - DNA, 2010 bp, Homo sapiens
accacaaggggcggtccccggtgtcctgcgcgggggcgcggagggggcgggcgtcagttccgcggggggctgtcggggaaccatggctgccccgagaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctgtaagtatccaggaattaaaggttcttagtagatcctttattttttttttaagttagatgtccattttaagctgttataacattttgaaattaatcctttgatactgtaaataccagtttgaatataattttcattttgttgacttagttttgattgtgaaggcaaaattgctttgggatagcaatgccccaaaatatctaacattagcaaaaaatgtgtaaaatttaatagaccacatagccctctgggcattgttttggaaaaacagtgttatataggaactaccaattttagtacaaactctcagatggctccttctaaggaaaacagtattttccttttcctaggtaaagtatggcatctctggggatgaaaattgcctcaccattatgtaatgtttcatttatttgagtgataagattttatttctctctgtatacaagttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaaga

SEQ ID NO: 425833 - DNA, 726 bp, Homo sapiens
atcgttgatgtagcactccagctcccctttccaatgaagctattctgcagagtcctaggttcctactgttgtgatgagagattggtctcgtctacagtgcctttctgtatgtgagccaaatagtagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaaggtatattaacatctatacaaattaattttgtaggggtggcacattcattggttgtgtgactgtttattgggttcccatattttatcaaactgttttctgtaacacatttttcattctgttgaaattgaaaaataaaactgtccatttatcttttaaaaaaaaaaa

SEQ ID NO: 425834 - DNA, 1397 bp, Homo sapiens
atcgttgatgtagcactccagctcccctttccaatgaagctattctgcagagtcctaggttcctactgttgtgatgagagattggtctcgtctacagtgcctttctgtatgtgagccaaatagtagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtaagaaacaaaatgcacaccataacttcccataaatagaaaacttccttaagtcttatactgttcagttacattgatgcatgcagcatgactacatttctttgatttaaaataacttttgccttatagataggccttttttctttagcatattattagggataataatacttattggttgtttctcagaggagaatatgcataaaatatgttacagatggaacataccttagaaataatgtgttccatcccctccattttatggatgacagtccccaaagaggtgaaggaacttgtcctaaattagttaatagctaacttgtgaccacaactgtgccagtttcc

SEQ ID NO: 425835 - DNA, 1470 bp, Homo sapiens
atcgttgatgtagcactccagctcccctttccaatgaagctattctgcagagtcctaggttcctactgttgtgatgagagattggtctcgtctacagtgcctttctgtatgtgagccaaatagtagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaagtcaaagttcctgtcttattaattaagcattttcttggaggtagaatgttctacagcaaataaataggcacagagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtaagaaacaaaatgcacaccataacttcccataaatagaaaacttccttaagtcttatactgttcagttacattgatgcatgcagcatgactacatttctttgatttaaaataacttttgccttatagataggccttttttctttagcatattattagggataataatacttattggttgtttctcagaggagaatatgcataaaatatgttacagatggaacataccttagaaataatgtgttccatcccctccattttatggatgacagtccccaaagaggtgaaggaacttgtcctaaattagttaatagctaacttgtgaccacaactgtgccagtttcc

SEQ ID NO: 425836 - DNA, 503 bp, Homo sapiens
cagctttgacaggagtgaatccccaaggctaaacccaaatccttatttgccgcctactcacgcctttgtgaggactacgattcccagacggcaacgctcccttcactcaacttccttagctggcggggagacgcagtttacagaactacctccccaaccgaatttcacacacctgtcacctaggacgcggccgggaaggcctcccttcgatccgcgttctccccattttggggtgtagcttggattcctgagcccagttttagtgcgtggccgaccgggaggccggcgaggcgctctaggccgagcggcttcgtctctatgaccacaaggggcggtccccggtgtcctgcgcgggggcgcggagggggcgggcgtcagttccgcggggggctgtcggggaaccatggctgccccgagaggtgagaactgggtctgctgggagtggggagtccgcggggggcggcggcgggcgagcatctgcgctggtcagcccctgtcgggca

SEQ ID NO: 425837 - DNA, 756 bp, Homo sapiens
tgatgaaatagttaaagtagcaggggatgaatttttttataggtaatatcaacagttttcctaatctcattattcaatatactcagaatctctcagagctttgactagagatagtggtaaatctagttgttgtcatattttcccaaacagaactataattttttaaagaggatacattattggtatgtttcttttaatctaaaactagttagaaattattagtttgctaaattacagcaagcatagtatgcttgtcctgtgtttgaagaagtcttattaaaataatactctttaattttcttccttaccaccctctcatctcccccttttgttttcaaagagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtaagtggagttaatgataatgaaaagcacagaatcttttatggtaaaaagagtttttattaactctttatcatattatcaattttttttttttttttgagatggagtctcgctctttcgtctaggctggagtgcagtgacgtgatctcagctcactgcaatctccgccgcccaggttcaagcgattctcctgcctcagcctcccgcgtagctgggactataggcacatgccaccacacccagctaattttttgta

SEQ ID NO: 425838 - DNA, 2348 bp, Homo sapiens
accacaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctgtaagtatccaggaattaaaggttcttagtagatcctttattttttttttaagttagatgtccattttaagctgttataacattttgaaattaatcctttgatactgtaaataccagtttgaatataattttcattttgttgacttagttttgattgtgaaggcaaaattgctttgggatagcaatgccccaaaatatctaacattagcaaaaaatgtgtaaaatttaatagaccacatagccctctgggcattgttttggaaaaacagtgttatataggaactaccaattttagtacaaactctcagatggctccttctaaggaaaacagtattttccttttcctaggtaaagtatggcatctctggggatgaaaattgcctcaccattatgtaatgtttcatttatttgagtgataagattttatttctctctgtatacaagttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaaga

SEQ ID NO: 425839 - DNA, 2367 bp, Homo sapiens
atcgttgatgtagcactccagctcccctttccaatgaagctattctgcagagtcctaggttcctactgttgtgatgagagattggtctcgtctacagtgcctttctgtatgtgagccaaatagtagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaaga

SEQ ID NO: 425840 - DNA, 2034 bp, Homo sapiens
accacaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagacagggtttcaccgtgtaaatcaggatggtctcgatctcctgaccttgtgatccgcccacctcaacctcccagagtgctgggattagaggcgtgagccaccgtgcctggccaatcaaagtctttttagagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaaga

SEQ ID NO: 425841 - DNA, 2237 bp, Homo sapiens
atcgttgatgtagcactccagctcccctttccaatgaagctattctgcagagtcctaggttcctactgttgtgatgagagattggtctcgtctacagtgcctttctgtatgtgagccaaatagtagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttggttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaaga

SEQ ID NO: 425842 - DNA, 2077 bp, Homo sapiens
atcgttgatgtagcactccagctcccctttccaatgaagctattctgcagagtcctaggttcctactgttgtgatgagagattggtctcgtctacagtgcctttctgtatgtgagccaaatagtagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaagtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttggttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaaga

SEQ ID NO: 425843 - DNA, 1270 bp, Homo sapiens
accacaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggttaggagctatggagtaggatcatgaggagtatattttgaaaaagttttaaagagttcagatacttctctttggttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatg

SEQ ID NO: 425844 - DNA, 1729 bp, Homo sapiens
  misc_feature (4)..(4): n is a, c, g, or t
  misc_feature (7)..(9): n is a, c, g, or t
  misc_feature (11)..(11): n is a, c, g, or t
gatnctnnngnctcagcctcccaagtagctgggattacaggtgcccgccaccacacctggctaatttttgtgtttttagtagagacagggtttcaccatgttgtccaggctggtcttgaattcccgacctcaggcaatccgcccatctcaacctcccaaagtgctgggattacaggcataagccaccgcgcccagtagagatgtgatattattcaagtaaataaaacctgaaacttggcacatttgcctatttaatgtgcatcagtcatctgaactaggttgatcctggaataatgaaaacacttcactagtattaactaatgttttctacatagtagttcccaatagattaaggaaaatttccaacctgagattctttgttttggaatttgaataatgtgtttgtaactattccttgattgtcccaaatccaggctttacgtctgcttttgtcaatgtaacatcctagtgccaggaaattggaaaatccaatgactttttgtgtgtaaagtactggaatttttttgttcgtttgtttttaagacggagtgtcaactctcgcccaggctggggtgcagtggcctgatctcggctcactgcaaccttctcctcccaggctgaagtgattctcctgcctcagcctcgcaagtagctgggactgcaggcatgtgccaccactcctggctaattatttgtatttttagtagagagagggtttcaccgtgttagccatgatggtctcattctcctgaccttgtgatccgcccacctcggcctcccaaagtgctgggattacaggcgtgagccactgtgcccaccctggtatgttttttttaaattggccacttaagagttgtccttcagaaagtggagcagcagtgtgattagtaaaaacgatgggctttcctgcagctctggcttatggtctttgtttttccagttaacagctgttacttcatgctgttatagggggtggggggagaaagagaaagaatatgtctagtggcttaattttggggctcaatttgtttattatgtttttcctgcaaaagagtcaccagtcttgtcatggctcaatgcatattttaaaatgagtcaaagccaatttggaagctgctatcttaggttatttgtagtcaggcttcaaatggagagtgaaactttgactttgaaaactggtgctctatgctcaatgatggtcttacacattcctctagggaaaggtcaagaaataaatttggcttgattgtattctctcatttaccatataggaaatactatggtagaactgaaaatatgtacaatagtaaagtggtggctgagactgggcacttggaaaatagacttggattctaagtgtgaaactaattaaatacttttatgtgactggtagtagtcacagtctccttgattgattctagttccttttcaaagtggagagacctgaatatagattgtaacaggatgtccaaccttgccagacaagcaggcatatatgtctctgggatgcagaagcagttacaagttaatatatttaagcataatgttagccaatcctaggtgataccagagatgtgaatatttgatcatatttgagttcattccttgaaagtccaaacctaactggtcttaattgattacttcttagtattccgaattttagaatttaaaaccctatgaattttcagtttgtgcttacattttctaacattggatgtttgctttggca

SEQ ID NO: 425845 - DNA, 625 bp, Homo sapiens
  misc_feature (4)..(4): n is a, c, g, or t
  misc_feature (7)..(9): n is a, c, g, or t
  misc_feature (11)..(11): n is a, c, g, or t
gatnctnnngnctcagcctcccaagtagctgggattacaggtgcccgccaccacacctggctaatttttgtgtttttagtagagacagggtttcaccatgttgtccaggctggtcttgaattcccgacctcaggcaatccgcccatctcaacctcccaaagtgctgggattacaggcataagccaccgcgcccagtagagatgtgatattattcaagtaaataaaacctgaaacttggcacatttgcctatttaatgtgcatcagtcatctgaactaggttgatcctggaataatgaaaacacttcactagtattaactaatgttttctacatagtagttcccaatagattaaggaaaatttccaacctgagattctttgttttggaatttgaataatgtgtttgtaactattccttgattgtcccaaatccaggctttacgtctgcttttgtcaatgtaacatcctagtgccaggaaattggaaaatccaatgactttttgtgtgtaaagtactggaatttttttgttcgtttgtttttaagacggagtgtcaactctcgcccaggctgggatcacaccgctacactccagcctgggcaaaagagcgagactctgtctcaaaaa

SEQ ID NO: 425846 - DNA, 2137 bp, Homo sapiens
tttttatcattacctaagagctttaggctaattgcctggtaaatagctgtccatctgatggcctttgacagggaacctaatccccaagataggattctttttcttaaaccaatcttgaaatcgcctgcattgaaacataagtggctgtgaccggccagaggagaaggtcctcaggggccaggggctcctcaggcttcctttgttactccattgcttgcttctctgccctcaggagcagctgcagaggacagtcttcattaagctcaagcatatgacaaaggggcagaacagaaaagaaaaacagcttattaggtataggcttttcatgataaattgcttgtattagttttgaaactaagcacctattggataggcattatactatttctatttagatatggtagatcaaggagctatgaaagttcccgttttgctttctaggtttgaaagttttctgtttgattctgactgtgatcttcaacccttccaaaatgtccttgtgttataatttcacttatttcattgccaaaagatgaagggacttgaatcttgttatagttgttccatcctgttaacaagttttcattttgtgtgtggatcaaattctggttagcttggtttctttgaattactggtgccatctcagcaaaggcctgtggttatttttccccttgagtgggagttggtcatattcaagcatcctgttctcttaaaactctccttttaaaaaataaacacttccataacattttgttttggaagtctattaatgcaatcccacttttttccccctagtttctaaatgttaaagagaggggaaaaaaggctcaggatagttttcacctcacagtgttagctgtcttttattttactcttggaaatagagactccattagggttttgacattttgggaacccagttttaccattgtgtcagtaaaacaataagatagtttgagagcatatgatctaaataaagacatttgaagggttagtttgaattctaaaagtaggtaatagccaaatagcattctcatcccttaacagacaaaaacttatttgtcaaaagaattagaaaaggtgaaaatattttttccagatgaaacttgtgccacttccaattgactaatgaaatacaagagacagactgaaaaagtggattatgcatcttaaaaccctttctgtaaatattatgtagctaaagattgatttccagcatctgacatgacagtaggtttcttgttaaccagtttttcttctttctggataattgcatatgaatatttatacatactgaccaaaataaaggcctcaacttggtagtttactgaaagttcttggacaaatagtccataaaagctgttgacctctaaatgcactatggctggttaaatacagtgaccatccttcttccagctgtaaaggatgaagcgtattaagcattagccaggcagtaataaagctaaatagccatacagcagctctgacaatgttgtgctggatattgcagtttgctttcaaggtgcagatgtaaggatttaaaaaaataataatttggcaccaaataaatatgagtagcatccattggcctattaaatcgagtcaggatttgaagggaattgagtttgagaaatgaataaataaaggcaccttggtgcctgaccccctcaatcatgcgtgtgactttgagcactcacaggtgtgtgcagctactcagcccagggcaggtgggttagcctggggttataccttggccctgggaatagacaccattgggcctttggttttgttgggcttccttttgtctttacactccacacaggtggtagaaatctgagttctaaagcacttttgtgaaatacaagctaagtgagaattctaaagaaaatgctttggtttctgctgtctcaaataagtggcatttaaaaacaattattaataaatatttttaatggttttaactcagtatttttttttatttctttgtcactctttacagcttttgaagaccaaactgcaaatacattaccagggatggttttgtgttgtcctatagacttcttaaatttgacaaaaaatttagcagaacttgtaaccaacagctttgtctgaacttgaagtcaaaatgtgttgttaa

SEQ ID NO: 425847 - DNA, 1330 bp, Homo sapiens
  misc_feature (1)..(3): n is a, c, g, or t
  misc_feature (5)..(6): n is a, c, g, or t
nnnannacagactctctggaaagcctgggagctgaattccggaagatccccacatcgatgaaagcaaagcgaagccaccaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaacttttttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaac

SEQ ID NO: 425848 - DNA, 1275 bp, Homo sapiens
  misc_feature (1)..(3): n is a, c, g, or t
  misc_feature (5)..(6): n is a, c, g, or t
nnnannacagactctctggaaagcctgggagctgaattccggaagatccccacatcgatgaaagcaaagcgaagccaccaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaacttttttttttttttaaccaaatagataggggaagggaggagggagagggaggacaaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaac

SEQ ID NO: 425849 - DNA, 1839 bp, Homo sapiens
  misc_feature (1)..(3): n is a, c, g, or t
  misc_feature (5)..(6): n is a, c, g, or t
nnnannacagactctctggaaagcctgggagctgaattccggaagatccccacatcgatgaaagcaaagcgaagccaccaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaacttttttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaactttgtggcttttggtctgtgatgcttggtctcaaaggaaaaaataagatggtaaatgttgatatttacaaacttttctaaagatgtgtctctaacaataaaagttaattttagagtagttttatattaattaccaaactttttcaaaacaaattcttacgtcaaatatctgggaagtttctctgtcccaatcttaaaatataaaatatagatatagaagttcatagattgactccttggcatttctatttatgtatccattaaggatgagttttaaaaggctttctcttcatacttttgaaaaatttcttctatgattacagtagctatgtacatgtgtacatctatttttcccaagcaatatgttttgggtttagagtctgagtgatgaccaagattctgtgtgttactactgtttgtttaataggaacaaatatagaaataatattatctctttgcttatttcccgttaaaactataataaaatgtttctaggacagcatacgtaaa

SEQ ID NO: 425850 - DNA, 1277 bp, Homo sapiens
  misc_feature (1)..(3): n is a, c, g, or t
  misc_feature (5)..(6): n is a, c, g, or t
nnnannacagactctctggaaagcctgggagctgaattccggaagatccccacatcgatgaaagcaaagcgaagccaccaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaatgtaatgagaactaaagaaaacagatggctggagatgacatttatccagggtcactttgtcaggccctaggacttaaatcgaagttgaacttttttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaac

SEQ ID NO: 425851 - DNA, 1274 bp, Homo sapiens
  misc_feature (1)..(3): n is a, c, g, or t
  misc_feature (5)..(6): n is a, c, g, or t
nnnannacagactctctggaaagcctgggagctgaattccggaagatccccacatcgatgaaagcaaagcgaagccaccaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggatgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaacttttttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaac

SEQ ID NO: 425852 - DNA, 1048 bp, Homo sapiens
  misc_feature (1)..(3): n is a, c, g, or t
  misc_feature (5)..(6): n is a, c, g, or t
nnnannacagactctctggaaagcctgggagctgaattccggaagatccccacatcgatgaaagcaaagcgaagccaccaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggaaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaacttttttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaac

SEQ ID NO: 425853 - DNA, 3441 bp, Homo sapiens
aaggagcgtccctgcttcacccccaacttggctggagaagaaaggacaagaggcagcagggtgaagaagaagccccccatcccagctggtggagatagttctggaactggaccccgcagctgcgtgggcagccgacacacccaccccagcactggcaccagaccagagccagagccaggacctgggcaaagtgcagccgtgcaccctgcctggtcactgctctcccagccctgcctgggcctacctcctgcccagctctgcttgggaccctctgggcatgcagcagcagtagcctaagggctctggtcacttccagggctctacagggcagcagagcagagcaaaagggtgcatatgctgggagctgtcacctccactcctaggcttttctgcctagagcagaattataggggcagtatacatccaggggtctgtgcggtggggctgggggattccttaagtgactttgggaaggatttgttttcccgagcatcaatttcacacctgggcattgcaccccaggctatgcagtctttcagtgtgaggaaggggcagaacaagaatgaggcggccccgtggcctcaaggaagcttgtggctttggaggatctgactccagcagagtctgtgccaatgtggggtgagcagggcccctgccatggagcagcaggaatttgagggatggagcaggttaaagaatgggaaacatcttcacttgtttttttttcttgcaaactactccctgctactcattgagactggttactggaagcaacttgttaagatttttctttctgggcgggcgcggtggctcacgcctgtaatcccagcactttgggaggccaaggcgggtggatcacctgaggtcaggagttcgagaccagcttagccaatatggtgaaaccccgtctctactaaaaatacaaaaattagccgggtgtggtggcatgtgccagctactcgggaggctgaggcaagagaatcacttgaacctcggaggctgaagttgcagtgagccaagattgagccattgctctccagcctgggtgacacagcaagactctgtctcaaaaaaaattttttatttctttcttttccatggaggcctagagtccctgtgaaggctaggaaggggctgctgatcccaggagtgcccacgaggagtggggggcactgttggcccataatcaggcaaacacccatcatttcatgggggattcatgaaatcatagtcaggcaaacacccgtcatttcatggctaagcatttgcagaaggtggaggattctcccccgagtccccaaatcagcagcctgtgctagggaccagagcaccgggggcaagaagacagaaccaatgtgggagtggggatggtcactaaatctgactgtgccacacaagcccatgatgaccttggcactggtttgggtggcaggatatgaaggaagctgtaggcattattgaaaaaatcattgttcagccaacagggtgaggctcccagcaaggccgtgccatcttcccacctccctgtgcccagagggttagactgtaagctcccggagggcgaggctggggctgagcgtgcctccacgtccccaaggcacagggtgcacagtgggtgctcactgaatatagtggactagtgagcagaggatgagaggactaccctgtaatgagccttggacagtctggcatttgccttaactcccactcccatgccctgggatcactgttggatatttactccatgaggacaaatactggggaggtgtggagaggagggagggcaggttcctcttactttcacccattgctgagaatgagcgcctgttggcactgcctttgtgagcctccgggagcaggtaacctgcggcccaagcccgcctaggactccacatcaggcaggcacaggactggccccttgtcctcataaaaactctcagtacagcttaaactctgtaagatctaaccagccaggaggaccctcgcttcctctccgccatgcttgccacctcttgcttctgagagtccatctcagttcgcagttctgtgacttgcattgacctggctccaatcaagctacaactcaagcagtcacggggagaaggattgtagatgggccagtgactcacagggtcaggcactcgggggagcctgagtcaggaggtcagtgggccctggaagggagggggcaagcctgggtgggtaaggttctgggccccaggcaagaaggcagagtttctccgcaggggtgtgtgcaagagctagctgcgcagaaggtctccgctggctctccaagccgggcttgtgaaataggaacgccaacatcctcctccacaggcagtggcaggcacctcctcctcaggtgccccccaagccctatctgatgggcaaaggtgaacgcagggcggtgggcttttcctgtgcagagggagactgattcaaagggtcatttatgacctttcacaagtcccacatcctgcccaatggccaggtcttgggatgctgttgcaagatggttctgtgactccatgtgactgtctgatgattgccccagctggggaaaaggctcccatgtctctttctcataaaaccagtgggcaaggccgggcgcagtggctcacgtctgtaatgccagcacttcgggagaccaaggtgggcggatcacctgaggtcaggagttcaagaccagcctgaccaacatggtgaaaccccgtctctacaaaaatatggaaattagctgggcatgacggcgggtgcctgtaaccccagctacttgggaggctgaggagggataatcagttgaacccaggaggtggaggttgcagtgagccgagatcgcgccactgcactccagcctgggtgacagagcaagactccatctcaaaaacaaacaaacaaaaaactagcgggtgaaatgattcagtgacctaaggacagccagagcactaagctgctgggaacccatctgtgctgaaatgtagatttcccaggaaactcaggcttgggacaggcgcctacctgctcctcgggcaccaggtgattaggagaggtcgaatctcatttccacgtgagtgaggataaagactgggctgccaaggaggactcctcataaacattgacaaattgctctgccccgcctgtgatcccagacgactcctgcagtctgggatcctgagtgtcctgtgggttcatctcggatgggcgctgcataaacagcctgcagggaacgtctgggagaaccagcttcacaacagatataataaggaagaagtttgaaatattgcaagaattgcgaaagtgtgacacacagatacaaagtgggcacatgctcgtgggaaaatgttgccaatagacttgcttgactctggagttaccccgaaccttcaatttgtttaaaaaaaaaaaggcaatatcttgacgtgcaataaagtgaactgcaat

SEQ ID NO: 425854 - DNA, 3006 bp, Homo sapiens
aaggagcgtccctgcttcacccccaacttggctggagaagaaaggacaagaggcagcagggtgaagaagaagccccccatcccagctggtggagatagttctggaactggaccccgcagctgcgtgggcagccgacacacccaccccagcactggcaccagaccagagccagagccaggacctgggcaaagtgcagccgtgcaccctgcctggtcactgctctcccagccctgcctgggcctacctcctgcccagctctgcttgggaccctctgggcatgcagcagcagtagcctaagggctctggtcacttccagggctctacagggcagcagagcagagcaaaagggtgcatatgctgggagctgtcacctccactcctaggcttttctgcctagagcagaattataggggcagtatacatccaggggtctgtgcggtggggctgggggattccttaagtgactttgggaaggatttgttttcccgagcatcaatttcacacctgggcattgcaccccaggctatgcagtctttcagtgtgaggaaggggcagaacaagaatgaggcggccccgtggcctcaaggaagcttgtggctttggaggatctgactccagcagagtctgtgccaatgtggggtgagcagggcccctgccatggagcagcaggaatttgagggatggagcaggttaaagaatgggaaacatcttcacttgtttttttttcttgcaaactactccctgctactcattgagactggttactggaagcaacttgttaagatttttctttctgggcgggcgcggtggctcacgcctgtaatcccagcactttgggaggccaaggcgggtggatcacctgaggtcaggagttcgagaccagcttagccaatatggtgaaaccccgtctctactaaaaatacaaaaattagccgggtgtggtggcatgtgccagctactcgggaggctgaggcaagagaatcacttgaacctcggaggctgaagttgcagtgagccaagattgagccattgctctccagcctgggtgacacagcaagactctgtctcaaaaaaaattttttatttctttcttttccatggaggcctagagtccctgtgaaggctaggaaggggctgctgatcccaggagtgcccacgaggagtggggggcactgttggcccataatcaggcaaacacccatcatttcatgggggattcatgaaatcatagtcaggcaaacacccgtcatttcatggctaagcatttgcagaaggtggaggattctcccccgagtccccaaatcagcagcctgtgctagggaccagagcaccgggggcaagaagacagaaccaatgtgggagtggggatggtcactaaatctgactgtgccacacaagcccatgatgaccttggcactggtttgggtggcaggatatgaaggaagctgtaggcattattgaaaaaatcattgttcagccaacagggtgaggctcccagcaaggccgtgccatcttcccacctccctgtgcccagagggttagactgtaagctcccggagggcgaggctggggctgagcgtgcctccacgtccccaaggcacagggtgcacagtgggtgctcactgaatatagtggactagtgagcagaggatgagaggactaccctgtaatgagccttggacagtctggcatttgccttaactcccactcccatgccctgggatcactgttggatatttactccatgaggacaaatactggggaggtgtggagaggagggagggcaggttcctcttactttcacccattgctgagaatgagcgcctgttggcactgcctttgtgagcctccgggagcaggtaacctgcggcccaagcccgcctaggactccacatcaggcaggcacaggactggccccttgtcctcataaaaactctcagtacagcttaaactctgtaagatctaaccagccaggaggaccctcgcttcctctccgccatgcttgccacctcttgcttctgagagtccatctcagttcgcagttctgtgacttgcattgacctggctccaatcaagctacaactcaagcagtcacggggagaaggattgtagatgggccagtgactcacagggtcaggcactcgggggagcctgagtcaggaggatgcttctggctggcacacctggcttcccctccatgctcagaactgcttcctactctacatccaggctcctgagcagcccccagcttaagcttcagcagctccagggtaaatccatctccgcccagagctgactccggatctgccccagtgacaataacaagataaatgccttccattctcttcgtacttacaggatgtaatccacatatttacacagtgtttcatttgcggtaatgtttgttttgtttcttgttccttcgtacctatctgggaagcctgtgcaattcagatgtccaggcccacttccagaagttctcattccctgtgcttgagtcaatggccgcagaccatacacctgagagcaagttaatctgctctaacaaagatatcacatctaagaatggtggttggcaggggctggggggtgggaagaatggggagttggtgcttcatgggtacagagattcagttttgcaagaggaaaagagctctggagatggatgctgctgatggctacaccgcaatgtgaatgtgcatgatgcttaaatatggttaagatgggccgggcgcggtggctcacgcctgtaatcccagcactttgggaggccgaggcgggcagatcacgaggtcaggagatcgagaccatcttggctaacacggtgaaaccccatctctactataaatacaaaaaattagccgggcgtgggggcgggcacctgtggtcccagctactcgggaggctgaggcaggagaatggcatgaacctgggaggtggagcttgcagtgagccgagatcacgccactgcactccaggctgggcgacagagcgagactccgtctc

SEQ ID NO: 425855 - DNA, 1202 bp, Homo sapiens
gacgcggggacactcgtgcgactggggcaaggtgcccaggggcttctctcctaatttgcctcacgtaacagttgagaccccagagggcagcaaaactgggttcgaattggagagccgtccaggcacagacaaattcattcatctgcccagtgcccgctaactgcggttccaggcgccggcgacgcaattccagagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggaggatgcttctggctggcacacctggcttcccctccatgctcagaactgcttcctactctacatccaggctcctgagcagcccccagcttaagcttcagcagctccagggtaaatccatctccgcccagagctgactccggatctgccccagtgacaataacaagataaatgccttccattctcttcgtacttacaggatgtaatccacatatttacacagtgtttcatttgcggtaatgtttgttttgtttcttgttccttcgtacctatctgggaagcctgtgcaattcagatgtccaggcccacttccagaagttctcattccctgtgcttgagtcaatggccgcagaccatacacctgagagcaagttaatctgctctaacaaagatatcacatctaagaatggtggttggcaggggctggggggtgggaagaatggggagttggtgcttcatgggtacagagattcagttttgcaagaggaaaagagctctggagatggatgctgctgatggctacaccgcaatgtgaatgtgcatgatgcttaaatatggttaagatgggccgggcgcggtggctcacgcctgtaatcccagcactttgggaggccgaggcgggcagatcacgaggtcaggagatcgagaccatcttggctaacacggtgaaaccccatctctactataaatacaaaaaattagccgggcgtgggggcgggcacctgtggtcccagctactcgggaggctgaggcaggagaatggcatgaacctgggaggtggagcttgcagtgagccgagatcacgccactgcactccaggctgggcgacagagcgagactccgtctc

SEQ ID NO: 425856 - DNA, 760 bp, Homo sapiens
ctgtagctggactacaagaacatttgtaaggtagtggaaaggggcagcaagatctatagatttaataacttatttctctgcagttggagcagaaaggtactgacctcctggtgatagcaatggaaaattatggctccttgggcagcaaaaagggtgtagaccttcctggtgactgtggacctgcttgccatgtcagaaaaggacatccaggatctgaagtttggggtagaatgggatgtggatatggtgtttgcctctttcatccatgtggcatctaatgtccatgaaattagaaaggcaattattgcaaactggagcaaggtgcccacttgcccaccagagttaggctcttaccttcccagaggaactgagacccacagctatttttatatatcttacagttcagatcagatacaaatatgtaaacctctacattatttctatgtagaaattatgatactctttaagcctgtcacagattttgttatttaatgcaaagaagcacatatattactatgggacacttttggtttgtttaaatattttgatagttgtattttaatgtaaagggtttcatttgtaatcttatacagatggtccccaacttacaatggttcaacttatgatttttcatctttacaacggcatgaaagcaatacattttcagtagaaactgtaggtcaaatactcatacaaccattctgtttttcactttactgcagtatttaataaacatatgagatattcaagattttaactt

SEQ ID NO: 425857 - DNA, 2582 bp, Homo sapiens
caggtgatctacccgcctccacctcccaaagtgttgtgattacaggcgtgagccaccacacccagccctttcactaatttttggcagagttcacaatcccatcctatgtcagaaacttgaacctaacttaagaaattttgagtcatttttttggaggactgaggctttgttctacctactcttgaagaatcctgatgaaatattcaaacacataaagggatggccctggaggtctatcctgcatacctggagagcttctctggtcctgcccaccttgaaagttgcagactttgttgtaacatctatgtgatgagcttccctgtgaagccccatttgacaggtgggccagcagtgttttatcagcactctgatggcccacatttcccaggaaaacttcttgaaacttaccgttgtgggcagtggtcagagcgtgtagttcttatgactgtcttgtttcatctgtggagcacgtgtggagcacgttggtacagcagtttctgtggggtttggcatgggtgattttggttagtaaccatcctccaattgttgcttgtgaaagtcattcataacttgttccttttacttagttttgttgttactgctgttgttgttggtttggttggttttgagaccgggtctggctctgtagcccaagctggaatgcggtggcgcgatcatggctccctgcagcctcaaactcctgggctcaagcaatcctcctgcctcagcctcccaagcagctgggaagataggcacgtgccaccacacccggctaattttttctttattttttttgtagagatgggggtctcactatgttgcccaggctggtctcaaactcctgggctcaagcgatcctttggcctcggcctcccaaagtgcatgagccaccatgcctggcctgtttagttttgtttcaagttgaaatacctttcttgtgttttctaattagaaaagtaatatctactcattgtaaaaactcaaacagtgcagaaatgtagaaagtagaaagtgtaagtccctggttgtcccttctgcctgagacaaccactgctcacagtttgatgtatatccttccagagactctcaaatttaagcaaataatttttattaccatgtctttttatttgaagacgtacatttgcctccaaagttcaacacaagttcaactgaccatatccttccatgacctgaatagatgctatcctttatcacgatgttcaattgcctttgaaagagagtagtccaggtatattcctgatcaaaatttggcatttttgatgatactactctacacagatcagactcatgtgcagaatcgtgcctggagagagaggtttggttaagacagagatttctggaaacattcaaattgcaaatggaaacttgaaacccacaatctaatgaggaatgtactggaaaaataatctgaagagttgacaaattgtgtactagattgaacacatggaatgcaatgcaatgagactttctgcactaaaacttatcctcatatgtacaacaatgatgtgtgtattatataacagtgatgtgtacatttctgacaccccatacataatatacacagtttgtataaatgcatacatttaaaaatatatatgtacaatacagctaacataaaactgtagtacgcctgaaggatattactagtgcctaatattgagtatgagtcactgcgtgttcgcatcaacttggaagtgcagtaattgttataaaattaatcagtgcagccaacattatttatgaatcacatctttgaaactgtgcagtagcatatacatatatatttttaaataacatttttcacagttttccagagttactgttgaaatctgcatcaccaaaaaaaaaaaaagcaagatttttttaacaatgtagacactcttcagacccagtaatctgcgtgtgatttcctatttgtagattcccaagagactttagcagtcaccagccttaatgcatgtacaggatattattgtgacttaatttatctgcagtttttaatccatgtgaaattggaatttataaacggacttggattaaacatgtctgcctttctaaggttgcaaatgttacattaaatgatttatgttgtaaatgagagaagttgagttgtacgtaaaagacatccaccaatttctgtgaatatttttacacggaaacttgagaatcaaaatacgttcaagtcagttgttctggctcccagtttataatctcgaaaagcaatctttttgtttcataaatggcttaaatgtagctcccacagattatcagtatgaagtctgacatttttcatggaaaagaagtatgtttttcttcattataactatagtttactatttgtctttgctatttcctgatacatacacatacgcacacacgcgcgcacatgcatgcacgtatgcacatgcacgctcccagtgtcccagtgaaggctcaacaggaagcttgagaaggtcatctcaatggccacagggttcctgttcaaccagtagccctgggatgccgctttgcttgtcattctttagtgtcacaagttagttccctgacttgtgtgcagtcag

SEQ ID NO: 425858 - DNA, 3217 bp, Homo sapiens
gaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaagcttccctttgctgaaggtctgtaccacttttatcacaatggccttgcaaaggccaagagaagacgcagcctacaccacaagcagcagctggagagagaccccagggtaaagatggctttgcagcaggaaggatttgaccgaaaaaagcgaggttacagagacatcaatgagatcgacatcaacatgaacgatcctctttttacaaagcagtggtatctgatcaatactgggcaagctgatggcactcctggccttgatttgaatgtggctgaagcctgggagctgggatacacagggaaaggtgttaccattggaattatggatgatgggattgactatctccacccggacctggcctccaactataatgccgaagcaagttacgacttcagcagcaacgacccctatccttaccctcggtacacagatgactggtttaacagccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaatcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcatt

SEQ ID NO: 425859 - DNA, 3166 bp, Homo sapiens
ccccaactagcaccctcgctgtccttgtgcagtggaacgtccccaggtctgagaatgcacctcccgccgtgtccaccccggccgcgtctctcctgaaggcagatcttggaggtgcagccaggactcctagaggagcctcctccagtcaccatcgcgggtggggcgagccgggtctcctgctgggcttcccagccgcttcgctccggacctgcctggagcctacaaaaaacaagggctcgtccttgcactctcgccccccatggatcacccctagaagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaagcttccctttgctgaaggtctgtaccacttttatcacaatggccttgcaaaggccaagagaagacgcagcctacaccacaagcagcagctggagagagaccccagggtaaagatggctttgcagcaggaaggatttgaccgaaaaaagcgaggttacagagacatcaatgagatcgacatcaacatgaacgatcctctttttacaaagcagtggtatctgatcaatactgggcaagctgatggcactcctggccttgatttgaatgtggctgaagcctgggagctgggatacacagggaaaggtgttaccattggaattatggatgatgggattgactatctccacccggacctggcctccaactataatgccgaagcaagttacgacttcagcagcaacgacccctatccttaccctcggtacacagatgactggtttaacagccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaatcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcatt

SEQ ID NO: 425860 - DNA, 2860 bp, Homo sapiens
tctagaggccatctcacttgtgatgtgagaactagaacatctggccatctgtccaaggaaggattaaggaagcttaccctacatcttgggttccaggtgaaatccattaaccacaagggctacatcaacttgaaaggaagacagtcctggagaacacagggcttacatttgctaaccccttgaaggcttgaaataggatgaaatggggaagcctgaaagagaatatcaagagaggatggaaaaccccaaagacatgctttggctccaacacaattttgtgaggtttggtccagtgcagcacactaatccagcactccagggaggactagaaatgtttaaagtctcccagcgctttccctttactgcgcctctggctgtacggacctaatgagatgccttgtgtttttcagaatgccgaagcaagttacgacttcagcagcaacgacccctatccttaccctcggtacacagatgactggtttaacagggactaaagctcccaccttgaaggcttgtactgcggattcaagacaggtatagagtgcttggtacagagcatggcacatgccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaatcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcatt

SEQ ID NO: 425861 - DNA, 392 bp, Homo sapiens
gatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaaaagagaaaaaaaattaagacaagcctggcaacacacctggtgaagagtagtttactagcttttcaaacaagaatgtcccttttcctaagtcactttgaggtgtctcaatctgatctgagtgagaggcgacaggagtatttttttttttttacagctttacacacacagat

SEQ ID NO: 425862 - DNA, 2431 bp, Homo sapiens
gaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaagcttccctttgctgaaggtctgtaccacttttatcacaatggccttgcaaaggccaagagaagacgcagcctacaccacaagcagcagctggagagagaccccagggtaaagatggctttgcagcaggaaggatttgaccgaaaaaagcgaggttacagagacatcaatgagatcgacatcaacatgaacgatcctctttttacaaagcagtggtatctgatcaatactgggcaagctgatggcactcctggccttgatttgaatgtggctgaagcctgggagctgggatacacagggaaaggtgttaccattggaattatggatgatgggattgactatctccacccggacctggcctccaactataatgccgaagcaagttacgacttcagcagcaacgacccctatccttaccctcggtacacagatgactggtttaacagccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaac

SEQ ID NO: 425863 - DNA, 3007 bp, Homo sapiens
gaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaagcttccctttgctgaaggtctgtaccacttttatcacaatggccttgatttgaatgtggctgaagcctgggagctgggatacacagggaaaggtgttaccattggaattatggatgatgggattgactatctccacccggacctggcctccaactataatgccgaagcaagttacgacttcagcagcaacgacccctatccttaccctcggtacacagatgactggtttaacagccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaatcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcatt

SEQ ID NO: 425864 - DNA, 1730 bp, Homo sapiens
gtggtcaagttggcaaaccgtggtgtcgtcctagcagtagattcatctatagactagttgtcagctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaatcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcatt

SEQ ID NO: 425865 - DNA, 543 bp, Homo sapiens
gcaacgtgttggaccttccggagcttctcagaagacagagggttttcttttgaggtaaatttgatagtacattttgatagtacaggaggcgatacggcatggtgacagaaaagcgccggcttggttagcgggaccacctggcagggctgcaggctgtgccacttaccaggcaggggaccttgggccagctgcttggcctcactcaccctgtttcctcagctgcaattgggatgaacagactgcctgcttcggggttgcctaaaactcacattgcttaatgatgtgaaatgcttagcgcagtgcctggcatagagagaattctcattagatgatacctcagctgggctttaggagctacagaagaagctgcatctccatgagctcagcgtgtttctagctttcctttttgttttctattcaacctttcacccaactcagcttctcaatccctaaatgacaaaggtttgggaaggaagacttggaccgatgcttgcatttgtttctgagaattaaacgttatgttttcttcaatccaaataggtt

SEQ ID NO: 425866 - DNA, 499 bp, Homo sapiens
accatttttaacctacaagaatggcgatttcatatggttcatttggtttataaatacttgctgaataaatgaatgaactgaaattttgagttgatgccaccaggaagagaatagacagttatatttgtgcacagttagaaagagttcgctgtcctgagttcacttgatcactttttatcctaaattgccacccgctaccgtcgtcgtcttccacataataattttctattaggaaaattattcattaaaacagataacatgggtcacttaagtgtaaaacttaaaggtaacacttttttaaggaaatctaccagaagaaaatctttttctaatttttaaagtttaatgaaacataatttacatacaatgtaaatggctaataatttacgtacgatagctaatttttaactcttcatgtttttctgttggcaggcaacgtgttggaccttccggagcttctcagaagacagagggttttcttttgaggtaaatttgatag

SEQ ID NO: 425867 - DNA, 4678 bp, Homo sapiens
catcaataaccttttcagatgaaagcttatagttattcttcaataaaaattcattgactaagaagtttagagctctcttttcaagaggtttgattggctcctgaatttcaggacttgatttgtaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcagataaaggagtatttgcatatacataatgagatatcttgggaatgggacccaagtctaaacacaaaatgtgtttcatatacacattatacacatagcctgaaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacattttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttgaaaaaatt

SEQ ID NO: 425868 - DNA, 4612 bp, Homo sapiens
ggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacattttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttgaaaaaatt

SEQ ID NO: 425869 - DNA, 4612 bp, Homo sapiens
ggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgactcttcgaggcatgagtgaagcgttagttgacaagcgggttgctccggcccttgttaccttgtccagtgatcctgaattctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacattttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttgaaaaaatt

SEQ ID NO: 425870 - DNA, 3448 bp, Homo sapiens
ggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgactcttcgaggcatgagtgaagcgttagttgacaagcgggttgctccggcccttgttaccttgtccagtgatcctgaattctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaa

SEQ ID NO: 425871 - DNA, 3528 bp, Homo sapiens
tatgtccactagtgtaggccatctggggatggctgcctggtttcaattttgcagctcagaggagagaatgctacacttcagttatagtatctgccacagctttctggcaggaaattggcaagaggtattctatgtttaccactccctctctttggtttgctcatcagtggatacatggcaaggctaggattatggatggccttctttcttgcttaaaaatatgttcttaatttattgaaatttttattactttttattaagtgttttattttaagtttatccctttaaaaatctacatttgcctttttctcattgacagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacattttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttgaaaaaatt

SEQ ID NO: 425872 - DNA, 2313 bp, Homo sapiens
aaccattttttattgcatgttgactggtttacagctgactcttcgaggcatgagtgaagcgttagttgacaagcgggttgctccggcccttgttaccttgtccagtgatcctgaattctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacattttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttgaaaaaatt

SEQ ID NO: 425873 - DNA, 2922 bp, Homo sapiens
attttagtaaactgcaaattgaaagcataaaaattttggacaacctgcctatagggacgcttagaagactttcaagaagaaagttctgatttccaattatggaaatcaagagtataccatctcatttgggttattaaaattctttgccatttatcagaaatgtttatgctagtggctcttcaggaaacactaagttgtattttacaaccaccaataaacatatgttttccaaagtaatgataatacttacttgtaacctagtaaacagttgtaattttaaatataatcgcattatgatttttttctttacacttaaaatatacttatgtttttttaaattattttaataattttagattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacattttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttgaaaaaatt

SEQ ID NO: 425874 - DNA, 5008 bp, Homo sapiens
  misc_feature (5005)..(5005): n is a, c, g, or t
ggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacattttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgttttggcgaaaaaaaaaaaaaaaaaaaaaaaaacaaaacaatgtgtgtgggcgcgcgcgccctcgggccctctggaaaagagagtttctttaagaaccatatccggtgtggggcgcgcgcggggcgcccagagtaggggaaaggggaaccatgtgggccaataaaggtgggtgtgccccagaggagagagaccccggggcgcaagtgagaaaaggggcgcgtgggagtttctcacaccaacatataaaaaaaggcgccgcgggggggaacacccgaagaggcggtctctggagaaaaattccccaaagagggggaagtcagaggggggcaccatacaggggaggtcatactaaacagggggaggcccaaggaggaacctcagaatatctacaattaaccgccgcgagcccggtggggcnggt

SEQ ID NO: 425875 - DNA, 3469 bp, Homo sapiens
ggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggtttgggtacaattccaaatccttacattaattctctttacaattctctatttggtcctaatactatcttaattttgaagttctatcctttcaatcatccaggccttccttttacttcttctgaatatttagcctactattcctcct

SEQ ID NO: 425876 - DNA, 2842 bp, Homo sapiens
ggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttttattgtagaatagatacctacctatcaaatttgtaggagttgttcaagaggaaaaaatgaattttcttctcataatggcccccaaataacaattaaaggttgttttgggaacagattgaggtcagttttagaattagcctgtctaagtcaggcatggtgccacgtgtctatagtcccacctactcagaagctgaggtgggaggatcacttgaggccagga

SEQ ID NO: 425877 - DNA, 646 bp, Homo sapiens
ggaggctgaggtgggaggctcgcttcagcccaggagtttgaggctacagtgagccatctatgattgtgccactgtactccagcctgcatgacacagcaaaaccgatcttaaaaaaaaaaaagatattagcaataatatgaatttcaaaaatgtaagataaaatttcctcgaagattttttatgttttttttttatcttttaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagaggtgagagatagcaactaattagtcaagtccacagaaagtatttaaactatgtaaaagcgtacagtgagatcttgagtttctgtttttctcctgttttgattttagaactccatgttagtacagaaattagaagataaaattagtttgttaaatagtgagaaatggtcattgatggagcaaatcagaagacttaaaaggttagtacttgatcattattcctaaaaatcctcttaaggtgtt

SEQ ID NO: 425878 - DNA, 298 bp, Homo sapiens
catcctcagtcacagctaacccagttcttattccagtttaccaaaccattttttattgcatgttgactggtttacagctgactcttcgaggcatgagtgaagcgttagttgacaagcgggttgctccggcccttgttaccttgtccagtgatcctgaattgtgagtttcacagactgcgaccttaagttatcctgtctgtctttttgagcattcttcttggtctgctttttttaaatttatttaatttgtcattgctagagactaatacagtatatttaccttgtacttactttaata

SEQ ID NO: 425879 - DNA, 331 bp, Homo sapiens
tctttccgtgcatcacctgtgaataccccctgtgctgaccaatcagctgttggtgaagggggtgaatgaaactctggtagctcagagggttgttcctgctctcattactctctccagtgaccctgaaatgtaagtgtcatccctgccttttatattcagcatccctttcaaaatgtgcctgtcaagaaataaccatcagctcttaaatttattgaagaatctctttaaattaataatactggattatgcttatttgattttaaactttatcacattattctttatatatcatggttctttttaaatcaaccctcaccataagtgtaatttg

SEQ ID NO: 425880 - DNA, 2650 bp, Homo sapiens
gcatccacacctgatggtgtgactcggccgacgcgagcgccgcgcttcgcttcagctgctagctggcccaagggaggcgaccgcggagggtggcgaggggcggccaggacccgcagccccggggccgggccggtccggaccgccagggagggcaggtcagtgggcagatcgcgtccgcgggattcaatctctgcccgctctgataacagtccttttccctggcgctcacttcgtgcctggcacccggctgggcgcctcaagaccgttgtctcttcgatcgcttctttggacttggcgaccatttcagagatgtcttccagaagtaccaaagatttaattaaaagtaagtggggatcgaagcctagtaactccaaatccgaaactacattagaaaaattaaagggagaaattgcacacttaaagacatcagtggatgaaatcacaagtgggaaaggaaagctgactgataaagagagacacagacttttggagaaaattcgagtccttgaggctgagaaggagaagaatgcttatcaactcacagagaaggacaaagaaatacagcgactgagagaccaactgaaggccagatatagtactaccgcattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtttctttacacatctctgctaaagcagcaagaagaacaaacaagggtagctctgttggaacaacagatgcaggcatgtactttagactttgaaaatgaaaaactcgaccgtcaacatgtgcagcatcaattgcttgtaattcttaaggagctccgaaaagcaagaaatcaaataacacagttggaatccttgaaacagcttcatgagtttgccatcacagagccattagtcactttccaaggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagactactaacattttgcactgtcaaaatacttggtgaggaaaagatagctcaggttattgctaatgggttaatgcaccagcaagcaaaatattttatgttttgggggtttgaaaaatcaaagataattaaccaaggatcttaactgtgttcgcattttttatccaagcacttagaaaacctacaatcctaattttgatgtccattgttaagaggtggtgatagatactattttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgttttaaaaaaacta

SEQ ID NO: 425881 - DNA, 2182 bp, Homo sapiens
gcatccacacctgatggtgtgactcggccgacgcgagcgccgcgcttcgcttcagctgctagctggcccaagggaggcgaccgcggagggtggcgaggggcggccaggacccgcagccccggggccgggccggtccggaccgccagggagggcaggtcagtgggcagatcgcgtccgcgggattcaatctctgcccgctctgataacagtccttttccctggcgctcacttcgtgcctggcacccggctgggcgcctcaagaccgttgtctcttcgatcgcttctttggacttggcgaccatttcagagatgtcttccagaagtaccaaagatttaattaaaagtaagtggggatcgaagcctagtaactccaaatccgaaactacattagaaaaattaaagggagaaattgcacacttaaagacatcagtggatgaaatcacaagtgggaaaggaaagctgactgataaagagagacacagacttttggagaaaattcgagtccttgaggctgagaaggagaagaatgcttatcaactcacagagaaggacaaagaaatacagcgactgagagaccaactgaaggccagatatagtactaccgcattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtttctttacacatctctgctaaagcagcaagaagaacaaacaagggtagctctgttggaacaacagatgcaggcatgtactttagactttgaaaatgaaaaactcgaccgtcaacatgtgcagcatcaattgcttgtaattcttaaggagctccgaaaagcaagaaatcaaataacacagttggaatccttggtgagtctggaatgattaaactaaaatttgtcttcgtcttccatttatataccaaatcagttccgaacttaggaggatacagcttaacacacagctagctgtatctcaaatcagtaggtagagcctctgcctcatttgaagcaactgccctttgagcatcaattcagaggacatgaaagagggacatgatcacatctggaaacattcccccaactaccccagctgctgtgatgctggaggcactaaatagtgcctgagctggggtcaaaagggtagaatagagggtagtcacagaatcctgaactgaaattgtgtttatctattaaaaaagaaagaaaggctgggcacgatggcttatacctttaatcccagcgctttgggaggccaaggcaggcggatcatgaggtcaggagttggagaccagcctgaccaacatggtgaaaccctgtctctactaaaaatacaaaaaattagccgggcgtggtggcgggtgcctgtaacctcagctacttgggaggccgaggcaggagaatcacttgaacccgggatgcagaggttgcagtgggctgagactgagccactgcactccagcctgggcagcagagcaagactctgtctcaaaaaaacagcacaacacagaaacacaaacaacaacgccgaaacaaagggaaaacgggcacta

SEQ ID NO: 425882 - DNA, 2501 bp, Homo sapiens
gcatccacacctgatggtgtgactcggccgacgcgagcgccgcgcttcgcttcagctgctagctggcccaagggaggcgaccgcggagggtggcgaggggcggccaggacccgcagccccggggccgggccggtccggaccgccagggagggcaggtcagtgggcagatcgcgtccgcgggattcaatctctgcccgctctgataacagtccttttccctggcgctcacttcgtgcctggcacccggctgggcgcctcaagaccgttgtctcttcgatcgcttctttggacttggcgaccatttcagagatgtcttccagaagtaccaaagatttaattaaaaaaaattcgagtccttgaggctgagaaggagaagaatgcttatcaactcacagagaaggacaaagaaatacagcgactgagagaccaactgaaggccagatatagtactaccgcattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtttctttacacatctctgctaaagcagcaagaagaacaaacaagggtagctctgttggaacaacagatgcaggcatgtactttagactttgaaaatgaaaaactcgaccgtcaacatgtgcagcatcaattgcttgtaattcttaaggagctccgaaaagcaagaaatcaaataacacagttggaatccttgaaacagcttcatgagtttgccatcacagagccattagtcactttccaaggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagactactaacattttgcactgtcaaaatacttggtgaggaaaagatagctcaggttattgctaatgggttaatgcaccagcaagcaaaatattttatgttttgggggtttgaaaaatcaaagataattaaccaaggatcttaactgtgttcgcattttttatccaagcacttagaaaacctacaatcctaattttgatgtccattgttaagaggtggtgatagatactattttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgttttaaaaaaacta

SEQ ID NO: 425883 - DNA, 815 bp, Homo sapiens
agccacttaggcagcccaagtggactaagaaaggcattaagacaaaactacttaaaaagacaaaggacattatataatgataagagtcaatcaagaacatttaagaattaaaaacatatatgcccctaacaacacagccccaaattctatgaagcaaaaattgacagacttgaaggaagaaatggctcaacaataatagctagagacttcaacaccctactttcaataatgggtggtacaactaagcaaaagatacataaggaaaaagaagacttaaacaacaccgttaggcaactagacctaaaagacatatgcagaacactccaaccaacacgagcagaatacacattcttttcaagtgcactggaacatcctctagggcaacacgttagaccacaaaaaaacttgccgtaaatttcaaaagactgaaatcacacaaagtatcttttccaaccacaatgcaatgaagttagaaatcactaacaggaaaactgaaaaatttgcaaatatgtggaaattaaacaatacattcttaaatagttactcaaaaaagtaactacaggctaggtgtggtggctcacacctgtaatcccagcactatgggaggccgaggcaggtgatcacctgaggtcaggcgttcgcaactagcctggccaacatggtaaaaacctgtctctaactaaaaatacaaaaattagttggacgtggtggcgtgcacctgtaatcccagctactcaggaggctgagacaggagaactgcttgaacctgggaggcagaagttgcagtgaacagaaatgacaccactgcactccag

SEQ ID NO: 425884 - DNA, 5193 bp, Homo sapiens
  misc_feature (838)..(838): n is a, c, g, or t
accttcagttcctccaagtcctggaagactgagacaaggggaagaaagcaagataagtgcgatggatgcatctccacggaatatttctccaggacttcagaatggagaaaaagaggatcgcttcttaacaactttgtccagccagagctccaccagttctactcatctccaattgcctacgccacctgaagtcatgtctgaacagtcagtgggagggccccctgagctagatacagccagcagttccgaagatgtgtttgatgggcatttgctgggatccacagacagccaagtgaaggaaaagtcaaccatgaaagccatctttgcaaatttgcttccaggaaatagctataatcctattccatttccttttgatccagataaacactacttaatgtatgaacatgaacgagtgcccattgcagtctgcgagaaggaacccagctccatcattgcttttgctctcagttgtaaagaataccgaaatgccttagaggaattgtctaaagcgactcagtggaacagtgccgaagaagggcttccaacaaatagtacttcagatagcagaccaaagagtagcagccctatcagattacctgaaatgagtggaggacagacaaatcgtacaacagaaacagaaccacaaccaaccaaaaaggcttctggaatgttgtccttcttcagagggacagcagggaaaagccccgatctctcttcccagaagagagagaccttacgtggagcagatagtgcttactaccaggttgggcagacaggcaaggaggggaccgagaatcaaggcgttgagcctcaagatgaagtagatggaggagatacncaaaagaagcaactcataaatcctcatgtggaacttcaattttcagatgctaatgccaagttttactgtcggctctactatgcgggagagtttcataagatgcgtgaagtgattctggacagcagtgaggaagatttcattcgttccctctcccactcatcaccctggcaggcccggggaggcaaatcaggagctgccttctatgcaactgaggatgatagatttattttgaagcaaatgcctcgtctggaagtccagtccttcctcgactttgcaccacattacttcaattatattacaaatgctgttcaacaaaagaggcccacggcgttggccaaaattcttggagtttacagaattggttataagaactctcagaacaacactgagaagaagttagatctccttgtcatggaaaatcttttctacgggagaaagatggcacaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaacctcgatccatagtgactcccatttcctttctagccacctcattatagattattctttgctggttgggcgagatgatactagcaatgagctagtagttggaattatagattatattcgaacatttacatgggacaaaaagcttgagatggttgtgaaatcaacaggaattttaggtggacaaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtgtctgtttagactgtccgtaatggaatggtaaaactccatgaatttgcactttggtttttgatacctgtggagctgtctgtacgttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccagttaaacacgtgggcatttattgttttattgaggaatttgacttaaactgggaatcctgtcatgttgtttatctttccagcttgcctgtttttgagtatgtttgatgtttttaaaattttgtcttctctgtggatgacaggaggctacagcaattaactttaagcctccttttagagatatttttaaagcttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttgaaatataaaaaataaattaggcccaatccaagaaattgagtgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgttaagaaataggccaagtgcggtggctcacgcctataatcctatcactttgggaggcctaggcaggcagatcacctgaggtcaggagttcaagaccagcctggccaacatgaggaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgttttcggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttattttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgttaagtattgaatgactgtttccctttccttcaaggcctagagtatattctgaaaatttaggaatgaggaagaaatcttaatacttccttccttaacatacaacatgagtcccgagaataattgatagtagcaagagaaaactatgtcagtaacatgttgctttgtataaaaatcttatttataaatgtgaagctttttgatgccatcaaaacttattaaaaaataggatttacttttttctaattctgacctaagaaaaataatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttgtttttgttttttttttttttggtaacacaggtgcagtgtattatagaaaaaataaaaactacaatcattagcagttttaatactgctgtgtcagttttgtaaaaaatgtacattatgtcttttgacatgttgaattttaaactagggaaatgacattgtaaatcatagtagcctcttttaatttaatatgaaaaatgccactatattgaaagtacttaatgtattgtatatatttctctactttggttctagctattttatatgattgacatgttatttaaaagataactgccttgaacttttggagacttgtactgtaaataaagaaatcttaacaataaactcagaatctacttactccacttag

SEQ ID NO: 425885 - DNA, 940 bp, Homo sapiens
tgaagttatcatggtttattacgtagtattgggggaaattacatgtcataatgaagtttttgaatttaatcaactgaaggattattccttgggagaatgttaaggatctaatatttttattggcattgctgctgtactcacttctgagattcaagagtttgagtttttttcaaagtcctttggtcatattaatagaaaattatgttcagttattacatggataatccttatattggtattaaattataaataaccctttttgataagaatttattttgaccttctcttgattagaggcccacggcgttggccaaaattcttggagtttacagaattggttataagaactctcagaacaacactgagaagaagttagatctccttgtcatggaaaatcttttctacgggagaaagatggcacaggtaagggtattggactatgtgaagcatttagctactggaaccttttgtacctttggttcttaaatatagtgaatcagagagtaacatcttattttatagtaaatatttaactttggttactaggccatatttaacttttgacttgctcagccttggagaaagaatgaagaggaattattcttgtggagtggtcttaaaatacagcatatccaatattctagaatcacagaattggtagaataagaaggcagatctacttcccgcatcttttttgaagattaagaagctgaggcatacagaaattaagtacttcattaaaatcactcagttattcctagactcaggttagtctagattctaaaacagtactgttcaaagagctagtccttgaactgtttccagtctatgataagataaggaacgtgtgctagaatgtaattcagttcactgctttcttcattgagaacaccttctatgagaaaaatgtcagctgaactaaacaatatacttaataatg

SEQ ID NO: 425886 - DNA, 473 bp, Homo sapiens
gccttcaaaaactttctcttgaaatctttttctttcctaatgattcaggttatcatatctgcatacattttggctttcttaattatattcttaactctagagtacttagttaacttatgtattttaaaaatttgcatagtgatccagataaacactacttaatgtatgaacatgaacgagtgcccattgcagtctgcgagaaggaacccagctccatcattgcttttgctctcagttgtaaagaataccgaaatgccttagaggaattgtctaaagcgactcagtggaacagtgccgaagaagggcttccaacaaatagtacttcagatagcagaccaaagagtagcagccctatcagattacctgaaatgagtggaggacagacaaatcgtacaacagaaacagaaccacaaccaagtaagattacacatggaggaatatttataattagatttacctataattatggtttg

SEQ ID NO: 425887 - DNA, 4764 bp, Homo sapiens
  misc_feature (409)..(409): n is a, c, g, or t
aataggggtttttgttaaaaagggtgcttgattacgcaaaaacaacatgtgaaacaataagtaacaacatgaaggacaatgtgcaaacaaaagtatttgcattactcagattgattagcttcatatagtggttacaactaacaaagaaatgagctgaaaatttttatttttcatctgtagtgacctgtacttaaaattaatatgttacttcttatttttagccaaaaaggcttctggaatgttgtccttcttcagagggacagcagggaaaagccccgatctctcttcccagaagagagagaccttacgtggagcagatagtgcttactaccaggttgggcagacaggcaaggaggggaccgagaatcaaggcgttgagcctcaagatgaagtagatggaggagatacncaaaagaagcaactcataaatcctcatgtggaacttcaattttcagatgctaatgccaagttttactgtcggctctactatgcgggagagtttcataagatgcgtgaagtgattctggacagcagtgaggaagatttcattcgttccctctcccactcatcaccctggcaggcccggggaggcaaatcaggagctgccttctatgcaactgaggatgatagatttattttgaagcaaatgcctcgtctggaagtccagtccttcctcgactttgcaccacattacttcaattatattacaaatgctgttcaacaaaagaggcccacggcgttggccaaaattcttggagtttacagaattggttataagaactctcagaacaacactgagaagaagttagatctccttgtcatggaaaatcttttctacgggagaaagatggcacaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaacctcgatccatagtgactcccatttcctttctagccacctcattatagattattctttgctggttgggcgagatgatactagcaatgagctagtagttggaattatagattatattcgaacatttacatgggacaaaaagcttgagatggttgtgaaatcaacaggaattttaggtggacaaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtgtctgtttagactgtccgtaatggaatggtaaaactccatgaatttgcactttggtttttgatacctgtggagctgtctgtacgttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccagttaaacacgtgggcatttattgttttattgaggaatttgacttaaactgggaatcctgtcatgttgtttatctttccagcttgcctgtttttgagtatgtttgatgtttttaaaattttgtcttctctgtggatgacaggaggctacagcaattaactttaagcctccttttagagatatttttaaagcttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttgaaatataaaaaataaattaggcccaatccaagaaattgagtgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgttaagaaataggccaagtgcggtggctcacgcctataatcctatcactttgggaggcctaggcaggcagatcacctgaggtcaggagttcaagaccagcctggccaacatgaggaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgttttcggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttattttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgttaagtattgaatgactgtttccctttccttcaaggcctagagtatattctgaaaatttaggaatgaggaagaaatcttaatacttccttccttaacatacaacatgagtcccgagaataattgatagtagcaagagaaaactatgtcagtaacatgttgctttgtataaaaatcttatttataaatgtgaagctttttgatgccatcaaaacttattaaaaaataggatttacttttttctaattctgacctaagaaaaataatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttgtttttgttttttttttttttggtaacacaggtgcagtgtattatagaaaaaataaaaactacaatcattagcagttttaatactgctgtgtcagttttgtaaaaaatgtacattatgtcttttgacatgttgaattttaaactagggaaatgacattgtaaatcatagtagcctcttttaatttaatatgaaaaatgccactatattgaaagtacttaatgtattgtatatatttctctactttggttctagctattttatatgattgacatgttatttaaaagataactgccttgaacttttggagacttgtactgtaaataaagaaatcttaacaataaactcagaatctacttactccacttag

SEQ ID NO: 425888 - DNA, 3802 bp, Homo sapiens
ttagacatcgctcatctctaggcaggagctagtctttttaaacagaaactcgtaccaggtaggacttgtcccatggcatgtggcacaacagataacctttcctgcccactcagactgcttctgcatgtgtatctttatggcagtttatatgaaagaacatggtcagttgacttcagttgcccaatcaattatataacagctttttcccccttttctctttcataatctcaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtgtctgtttagactgtccgtaatggaatggtaaaactccatgaatttgcactttggtttttgatacctgtggagctgtctgtacgttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccagttaaacacgtgggcatttattgttttattgaggaatttgacttaaactgggaatcctgtcatgttgtttatctttccagcttgcctgtttttgagtatgtttgatgtttttaaaattttgtcttctctgtggatgacaggaggctacagcaattaactttaagcctccttttagagatatttttaaagcttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttgaaatataaaaaataaattaggcccaatccaagaaattgagtgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgttaagaaataggccaagtgcggtggctcacgcctataatcctatcactttgggaggcctaggcaggcagatcacctgaggtcaggagttcaagaccagcctggccaacatgaggaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgttttcggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttattttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgttaagtattgaatgactgtttccctttccttcaaggcctagagtatattctgaaaatttaggaatgaggaagaaatcttaatacttccttccttaacatacaacatgagtcccgagaataattgatagtagcaagagaaaactatgtcagtaacatgttgctttgtataaaaatcttatttataaatgtgaagctttttgatgccatcaaaacttattaaaaaataggatttacttttttctaattctgacctaagaaaaataatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttgtttttgttttttttttttttggtaacacaggtgcagtgtattatagaaaaaataaaaactacaatcattagcagttttaatactgctgtgtcagttttgtaaaaaatgtacattatgtcttttgacatgttgaattttaaactagggaaatgacattgtaaatcatagtagcctcttttaatttaatatgaaaaatgccactatattgaaagtacttaatgtattgtatatatttctctactttggttctagctattttatatgattgacatgttatttaaaagataactgccttgaacttttggagacttgtactgtaaataaagaaatcttaacaataaactcagaatctacttactccacttag

SEQ ID NO: 425889 - DNA, 2278 bp, Homo sapiens
gccgagtagaggaaaaatccaaagagctgcctttcacacctttgggctggcatcataacaacctggagctctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgttttcggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttattttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgttaagtattgaatgactgtttccctttccttcaaggcctagagtatattctgaaaatttaggaatgaggaagaaatcttaatacttccttccttaacatacaacatgagtcccgagaataattgatagtagcaagagaaaactatgtcagtaacatgttgctttgtataaaaatcttatttataaatgtgaagctttttgatgccatcaaaacttattaaaaaataggatttacttttttctaattctgacctaagaaaaataatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttgtttttgttttttttttttttggtaacacaggtgcagtgtattatagaaaaaataaaaactacaatcattagcagttttaatactgctgtgtcagttttgtaaaaaatgtacattatgtcttttgacatgttgaattttaaactagggaaatgacattgtaaatcatagtagcctcttttaatttaatatgaaaaatgccactatattgaaagtacttaatgtattgtatatatttctctactttggttctagctattttatatgattgacatgttatttaaaagataactgccttgaacttttggagacttgtactgtaaataaagaaatcttaacaataaactcagaatctacttactccacttag

SEQ ID NO: 425890 - DNA, 3214 bp, Homo sapiens
  misc_feature (409)..(409): n is a, c, g, or t
aataggggtttttgttaaaaagggtgcttgattacgcaaaaacaacatgtgaaacaataagtaacaacatgaaggacaatgtgcaaacaaaagtatttgcattactcagattgattagcttcatatagtggttacaactaacaaagaaatgagctgaaaatttttatttttcatctgtagtgacctgtacttaaaattaatatgttacttcttatttttagccaaaaaggcttctggaatgttgtccttcttcagagggacagcagggaaaagccccgatctctcttcccagaagagagagaccttacgtggagcagatagtgcttactaccaggttgggcagacaggcaaggaggggaccgagaatcaaggcgttgagcctcaagatgaagtagatggaggagatacncaaaagaagcaactcataaatcctcatgtggaacttcaattttcagatgctaatgccaagttttactgtcggctctactatgcgggagagtttcataagatgcgtgaagtgattctggacagcagtgaggaagatttcattcgttccctctcccactcatcaccctggcaggcccggggaggcaaatcaggagctgccttctatgcaactgaggatgatagatttattttgaagcaaatgcctcgtctggaagtccagtccttcctcgactttgcaccacattacttcaattatattacaaatgctgttcaacaaaagaggcccacggcgttggccaaaattcttggagtttacagaattggttataagaactctcagaacaacactgagaagaagttagatctccttgtcatggaaaatcttttctacgggagaaagatggcacaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaacctcgatccatagtgactcccatttcctttctagccacctcattatagattattctttgctggttgggcgagatgatactagcaatgagctagtagttggaattatagattatattcgaacatttacatgggacaaaaagcttgagatggttgtgaaatcaacaggaattttaggtggacaaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtgtctgtttagactgtccgtaatggaatggtaaaactccatgaatttgcactttggtttttgatacctgtggagctgtctgtacgttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccagttaaacacgtgggcatttattgttttattgaggaatttgacttaaactgggaatcctgtcatgttgtttatctttccagcttgcctgtttttgagtatgtttgatgtttttaaaattttgtcttctctgtggatgacaggaggctacagcaattaactttaagcctccttttagagatatttttaaagcttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttgaaatataaaaaataaattaggcccaatccaagaaattgagtgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgttaagaaataggccaagtgcggtggctcacgcctataatcctatcactttgggaggcctaggcaggcagatcacctgaggtcaggagttcaagaccagcctggccaacatgaggaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgttttcggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaactta

SEQ ID NO: 425891 - DNA, 3151 bp, Homo sapiens
  misc_feature (409)..(409): n is a, c, g, or t
aataggggtttttgttaaaaagggtgcttgattacgcaaaaacaacatgtgaaacaataagtaacaacatgaaggacaatgtgcaaacaaaagtatttgcattactcagattgattagcttcatatagtggttacaactaacaaagaaatgagctgaaaatttttatttttcatctgtagtgacctgtacttaaaattaatatgttacttcttatttttagccaaaaaggcttctggaatgttgtccttcttcagagggacagcagggaaaagccccgatctctcttcccagaagagagagaccttacgtggagcagatagtgcttactaccaggttgggcagacaggcaaggaggggaccgagaatcaaggcgttgagcctcaagatgaagtagatggaggagatacncaaaagaagcaactcataaatcctcatgtggaacttcaattttcagatgctaatgccaagttttactgtcggctctactatgcgggagagtttcataagatgcgtgaagtgattctggacagcagtgaggaagatttcattcgttccctctcccactcatcaccctggcaggcccggggaggcaaatcaggagctgccttctatgcaactgaggatgatagatttattttgaagcaaatgcctcgtctggaagtccagtccttcctcgactttgcaccacattacttcaattatattacaaatgctgttcaacaaaagaggcccacggcgttggccaaaattcttggagtttacagaattggttataagaactctcagaacaacactgagaagaagttagatctccttgtcatggaaaatcttttctacgggagaaagatggcacaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaacctcgatccatagtgactcccatttcctttctagccacctcattatagattattctttgctggttgggcgagatgatactagcaatgagctagtagttggaattatagattatattcgaacatttacatgggacaaaaagcttgagatggttgtgaaatcaacaggaattttaggtggacaaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtgtctgtttagactgtccgtaatggaatggtaaaactccatgaatttgcactttggtttttgatacctgtggagctgtctgtacgttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccagttaaacacgtgggcatttattgttttattgaggaatttgacttaaactgggaatcctgtcatgttgtttatctttccagcttgcctgtttttgagtatgtttgatgtttttaaaattttgtcttctctgtggatgacaggaggctacagcaattaactttaagcctccttttagagatatttttaaagcttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttgaaatataaaaaataaattaggcccaatccaagaaattgagtgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgttaagaaataggccaagtgcggtggctcacgcctataatcctatcactttgggaggcctaggcaggcagatcacctgaggtcaggagttcaagaccagcctggccaacatgaggaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgttttcggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaatcctcagtgttttgtgtatcttcaaaaggcacatacacgtttttaagtcgacc

SEQ ID NO: 425892 - DNA, 1840 bp, Homo sapiens
  misc_feature (36)..(36): n is a, c, g, or t
  misc_feature (42)..(42): n is a, c, g, or t
  misc_feature (44)..(44): n is a, c, g, or t
cggcacgaggcaggctggccccggctcccggcccangctccncnggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagctaaagcccctgctgctgctgctgcacatgccacagcaggcggtgggggctgcgtggggacaatccatcgtggagtgttctctcagcttaggtctggacaggagacttggcgggagatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttatttttgtaaaaaataaaataaaattagttaataaaatgatgtttcacagcaaa

SEQ ID NO: 425893 - DNA, 1933 bp, Homo sapiens
  misc_feature (36)..(36): n is a, c, g, or t
  misc_feature (42)..(42): n is a, c, g, or t
  misc_feature (44)..(44): n is a, c, g, or t
cggcacgaggcaggctggccccggctcccggcccangctccncnggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagtgcgtggggacaatccatcgtggagtgttctctcagcttaggtctggacaggagacttggcgggagatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttatttttgtaaaaaataaaataaaattagttaataaaatgatgtttcacagcaaa

SEQ ID NO: 425894 - DNA, 1982 bp, Homo sapiens
  misc_feature (36)..(36): n is a, c, g, or t
  misc_feature (42)..(42): n is a, c, g, or t
  misc_feature (44)..(44): n is a, c, g, or t
cggcacgaggcaggctggccccggctcccggcccangctccncnggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagctaaagcccctgctgctgctgctgcacatgccacagcaggcggtgggggctgcgtggggacaatccatcgtggagtgttctctcagcttaggtctggacaggagacttggcgggagatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttatttttgtaaataacataggtagtataatgtgtcgtgtcttcttctgctctgc

SEQ ID NO: 425895 - DNA, 617 bp, Homo sapiens
  misc_feature (36)..(36): n is a, c, g, or t
  misc_feature (42)..(42): n is a, c, g, or t
  misc_feature (44)..(44): n is a, c, g, or t
cggcacgaggcaggctggccccggctcccggcccangctccncnggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtgatgcatggattggcctcacccaaacgggatcgtagataccta

SEQ ID NO: 425896 - DNA, 1983 bp, Homo sapiens
  misc_feature (36)..(36): n is a, c, g, or t
  misc_feature (42)..(42): n is a, c, g, or t
  misc_feature (44)..(44): n is a, c, g, or t
cggcacgaggcaggctggccccggctcccggcccangctccncnggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagctaaagcccctgctgctgctgctgcacatgccacagcaggcggtgggggctgcgtggggacaatccatcgtggagtgttctctcagcttaggtctggacaggagacttggcgggagatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttatttttgtaaaaaataaaataaaattagttaataaaatgatgtttcacagcaaa

SEQ ID NO: 425897 - DNA, 2268 bp, Homo sapiens
  misc_feature (36)..(36): n is a, c, g, or t
  misc_feature (42)..(42): n is a, c, g, or t
  misc_feature (44)..(44): n is a, c, g, or t
cggcacgaggcaggctggccccggctcccggcccangctccncnggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagctaaagcccctgctgctgctgctgcacatgccacagcaggcggtgggggctgcgtggggacaatccatcgtggagtgttctctcagcttaggtctggacaggagacttggcgggagatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttatttttgtaaaaaataaaataaaattagttaataaaatgatgtttcacagcaaaaaaaaaaaaaaaactcctccaaggcggcggggacttcggggccaataggggcacccgggattccttcccagaggggggggcgcccggagatcccacacgatttaggggtcccccacttataaggcagagagggcgggtagaattatccgaagaggctggggcggataccctcaaggggggatcgattaagcagggggtaccccgggggtgtcgaccaaatcgtgtatctctcccggcctacacacaatctcaacaacacaaaactattaacgagcacaacaagaa

SEQ ID NO: 425898 - DNA, 1624 bp, Homo sapiens
  misc_feature (36)..(36): n is a, c, g, or t
  misc_feature (42)..(42): n is a, c, g, or t
  misc_feature (44)..(44): n is a, c, g, or t
cggcacgaggcaggctggccccggctcccggcccangctccncnggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcgccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttatttttgtaaaaaataaaataaaattagttaataaaatgatgtttcacagcaaa

SEQ ID NO: 425899 - DNA, 446 bp, Homo sapiens
aacccaggagaaaagcagtgagcagtcttttcttgtgcccctcagatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtgacctccacccctgactcgggaactccatcgaaggagaatgggccaggagggcatggcaggaagagagccaacgtggaggccagctgggcagggagactcagccttgaccagagcaagggaaggctt

SEQ ID NO: 425900 - DNA, 501 bp, Homo sapiens
catttgtattgctgagaaatagtctgtggatatgtcacaatttggataaacagttggatgctttccagttttgggctgttgcaaataatgctactatgaacataggcatataactcttaatatgcagaaatgctttatttctcctgtgtcagtagtacagtgtacgtgaatgcgtcacttttaaagacaaggccagactataacctaactgtaccatttgcattctcatcaacagtatgtgaaccttcttatttctctacattcttgccatacttggtatggttagtctttttaattttagttgttttaatagctgtataatagcatctgtctgtgattttattgcatttttctggtattttatggtattgaacatttgaacatcttgtatctagttgccacctgtatatcctctttggaagaatgtttattaatgtcttttgcttatttttaaatggatgttggtgatactttttcattaataaatagacgtataacaaa

SEQ ID NO: 425901 - DNA, 4449 bp, Homo sapiens
gcagaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtggccttgccgcacggacatgttgcgatttcattctggaaacaagttagacctatgtgataatgttagggttcctggagcaagctggatgacccac

SEQ ID NO: 425902 - DNA, 4551 bp, Homo sapiens
ccctacctgctggcaaccaccattatattttctgtctctataaactgattattctaggtatctcatatgagtggaattataaaatatttgtcctacatttggttgatttcacttagcatagtatcttcaagttcaacttctttttggaacaaaaagggaatgaatgagtgagtaaatggagaatcagcattaattgacctgtatggtcttagcctctctggctgtctcagctccaaagtcaggcttttcctgccagctcaaaatatcctttagcagaatgcattaacatgtcaggttaactgtcagtgtctttaaaaatggttagaagggcatggcatacacagtgaagtagaatcctgcacttaggctagtcctgttggaaagagaaggacttgaggtacaggagagcagtggcctctgctaatgtggaatttgctccagctaccctgcagaccacccaggagcaggggctaagacagcgtcctccagaactgccctggctcccaggactgtggtggaggggaatcaaactccttctaggtggggacttcctgcaccaagtgttacttggggccgtgaaaatttggttctccctctacagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtggccttgccgcacggacatgttgcgatttcattctggaaacaagttagacctatgtgataatgttagggttcctggagcaagctggatgacccac

SEQ ID NO: 425903 - DNA, 4052 bp, Homo sapiens
cagttccatgggatcctattacagctgcctacttccctgatgactagagggcaccgccaagcagtgtttaccaaaatcaacaggccagagcacagctggaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtggccttgccgcacggacatgttgcgatttcattctggaaacaagttagacctatgtgataatgttagggttcctggagcaagctggatgacccac

SEQ ID NO: 425904 - DNA, 4224 bp, Homo sapiens
gcagaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatacagccatttaggtacggatcctctagag

SEQ ID NO: 425905 - DNA, 4396 bp, Homo sapiens
gcagaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccattcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtggccttgccgcacggacatgttgcgatttcattctggaaacaagttagacctatgtgataatgttagggttcctggagcaagctggatgacccac

SEQ ID NO: 425906 - DNA, 3355 bp, Homo sapiens
gcagaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgttttttttttttttttttttttttttttttttttttttttttttttttggggggggggaaaaagggttaaagggggggaaaggggcgggggggggggaggggg

SEQ ID NO: 425907 - DNA, 1468 bp, Homo sapiens
cacctgtggagtggcggcccgctcaggtctggcatacgagatggctcagaaacggccctgccctacaggtgccccgcccagggagaaggacagatggagtccccagatgcctcccagacaacgtggctgcccaaaggcaaggctggggaggcaccttggtgcccatggtggcgagcaccccaggggtgaagggcttcccaacggaagcagaatgcagaggccttgccgtgagcccacatgggccagggaaggctttctgagaggctcctgccgccccccatacccatctcatacagagccaccctcacctgtggggtgtgtgccttgaggggagcgtgactcagctgggcctgcacttggaggagcttggggaggttccccaacttctctgggcctcattccctcacctgtgaagtgaagctgatgacggacctgtcttgtggggcacgggaggactgaggtagctacgtaagtgtgttcccagcacccagcactcagtcagcactggaaaagagtagccactaaggtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtggccttgccgcacggacatgttgcgatttcattctggaaacaagttagacctatgtgataatgttagggttcctggagcaagctggatgacccac

SEQ ID NO: 425908 - DNA, 1560 bp, Homo sapiens
gcagaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctttgagacgccggccattcccagacaaggtccacaggtcagtgtaaaggatctcctctcagcaggctcacctcccccggatccgtggtgcctcgcaccgccggagtttttgcctgagcccacagccgagttcctcctgtgttcggagtgttccactcgcagcaacctgctccggcaggttttgtcactctactctggtgggatggcgcgccacgatgtggcctgtccaagctgaagatgcatatctgtgttgggtagca

SEQ ID NO: 425909 - DNA, 520 bp, Homo sapiens
ctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtgggcggccggctcggaaaagtcctgtgcccagaagggagccagttctgacctgagtgataatgaaaggcttcctggaggacgcagcttgagccacacttgatgtgggagtgaactgggatagggacactcctgctgagagaatggcaagagcaaaagcacactggtggccaggaggtggtaagagccgaggttagaaaggtgaggggtgctcatttaa

SEQ ID NO: 425910 - DNA, 4472 bp, Homo sapiens
gcagaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcccagtcccggcttcacctgcagcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtggccttgccgcacggacatgttgcgatttcattctggaaacaagttagacctatgtgataatgttagggttcctggagcaagctggatgacccac

SEQ ID NO: 425911 - DNA, 4437 bp, Homo sapiens
ccgcagtcccattccggagtctcctgtctccgccccccgaattcccgcagccctccccgtctccgtcagccccgggtcccacccccctatcctctggtgtcaaccctgacagcccagtcccggcttcacctgcagcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtggccttgccgcacggacatgttgcgatttcattctggaaacaagttagacctatgtgataatgttagggttcctggagcaagctggatgacccac

SEQ ID NO: 425912 - DNA, 4097 bp, Homo sapiens
gcagaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtggccttgccgcacggacatgttgcgatttcattctggaaacaagttagacctatgtgataatgttagggttcctggagcaagctggatgacccac

SEQ ID NO: 425913 - DNA, 4220 bp, Homo sapiens
gcagaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatacagtaaggatccgtagatcacctc

SEQ ID NO: 425914 - DNA, 3542 bp, Homo sapiens
gcagaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtggccttgccgcacggacatgttgcgatttcattctggaaacaagttagacctatgtgataatgttagggttcctggagcaagctggatgacccac

SEQ ID NO: 425915 - DNA, 4408 bp, Homo sapiens
gcagaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtacatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtggccttgccgcacggacatgttgcgatttcattctggaaacaagttagacctatgtgataatgttagggttcctggagcaagctggatgacccac

SEQ ID NO: 425916 - DNA, 1528 bp, Homo sapiens
gcagaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgttaaagggtgttatgagctgttcactcattgcgtatttatggtcgtgtgtgttttctg

SEQ ID NO: 425917 - DNA, 1532 bp, Homo sapiens
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggccagtagccgccccctcgcgcaccccggccccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425918 - DNA, 2154 bp, Homo sapiens
  misc_feature (1584)..(1584): n is a, c, g, or t
  misc_feature (2151)..(2151): n is a, c, g, or t
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggccagtagccgccccctcgcgcaccccggccccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaatttttaaaatgaaaaaaaaaaaaaaaacaaaaaaaaaaaaaaaaaaaaaaanaaaaacaaaacaaataataaagaagaaaaaaaaaaataagaaaaaaaacaaagaggaggggcgcgcgcgcgcaacaatgagtagttccccccggggagggccaccaatcagcatcatccccgccgctttttgttgtatcaagaagggggcccccaagaagaggacgagcgcaaataaacaacaaagcagacgcgcagcgggggacagagctattaacaaaaaagcacgccgaggaagggagaaacaaacaggggtccagacaggggagaaataatctgtgagaagagaacaccctccatccttcggggggggaggaagcatcacaaggtggggcaacaaaccacaccccataaaggaagaatgtataaagaagacatctagcgtgggaggagattataacaaaaacatatacgagcgggtatgtataataggggagtaaaaccacagaagcgccgatatatatgtgcgccgcgagatgcataaaagtatttggacgaaaagagacaatataatgtatataaaacaaaatattatttaaacagggggggcggtcagatataataaggntgc

SEQ ID NO: 425919 - DNA, 1702 bp, Homo sapiens
  misc_feature (1565)..(1565): n is a, c, g, or t
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggccagtagccgccccctcgcgcaccccggccccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaaaaaaaaaacaaaaaaaaaaaaaaaaaaaaaaanaaaaaaacgtggggggctttcttttgtggggggggggaaaaaggggggttttgaaggggccctggtggccccatctggtgtttctcctggcccccttttttttgttcacagggggggaaattctgggggggtcccct

SEQ ID NO: 425920 - DNA, 1926 bp, Homo sapiens
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggccagtagccgccccctcgcgcaccccggccccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactctggttccaaatacctatgttcttttgataaaaacgtaatgcttcgtattatttacacatatacaggtttggccaaataagttgaagattagcttttccctcttgagtcagaggaacactaataactctattctgcagtatacttctatgggccttgagataggcatttctgaaagtatgttgtcccactgagatactatgtttacacatcaggccaggcacaagtgggctcattcctgtaaatacctagcacttttgggaagccaaggtgggaggaaccagttgagtccaggaagttctgaagacccgcctgatcacagtaaaggtgacccctgtggctaaaaaaaaaaaaaagaactagccggtgtggccaagtgccggatctaagaacaagaggagtaaggggaagaaccgaaactgggggggcagtcacaaaaaagggcagagacagcttgttgagaaac

SEQ ID NO: 425921 - DNA, 1348 bp, Homo sapiens
cgaataatggataggtagcgaggcctgggaggtgaggagggaggaagcgtccggagtggggcgggcccggactccgacccccggggcgcttcgagccccccagctggtcaccgaggcaccgccgcttcacccaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425922 - DNA, 1591 bp, Homo sapiens
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggccagtagccgccccctcgcgcaccccggccccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacagaaggcgcccacaccagtacctagggccgatattatcctccccaagccagcggctccccagtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425923 - DNA, 1686 bp, Homo sapiens
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggtgagcaccctgatgaaggccacggtcctgatgcggcagcctgggcgggtgcaggagatcgtgggcgccctccgcaagggcggcggagaccggttacaggtacctctggggcgtgcgggggccggccgggctgggggcggctggagaggcttcctgcccattgggccttcccgctttgctctgccgcggacccctcctagctctctgccccaagaaatggctgggagcttgaaggagagcgggttggttcgcctgtcctaaaacccaaatttcagatttctcaatatggtcatgctgcttcctctaattggacagaaggcgcccacaccagtacctagggccgatattatcctccccaagccagcggctccccagtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425924 - DNA, 1807 bp, Homo sapiens
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggccagtagccgccccctcgcgcaccccggccccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacaggtacctctggggcgtgcgggggccggccgggctgggggcggctggagaggcttcctgcccattgggccttcccgctttgctctgccgcggacccctcctagctctctgccccaagaaatggctgggagcttgaaggagagcgggttggttcgcctgtcctaaaacccaaatttcagatttctcaatatggtcatgctgcttcctctaattggacagaaggcgcccacaccagtacctagggccgatattatcctccccaagccagcggctccccagtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425925 - DNA, 1351 bp, Homo sapiens
cctgagtattcacccttgcccccacactaggagactgcgttttcctcagggttaacgggtactaattaggatcacttcccctctatccctctgtgtcactcggtaactcccctagggctttgcctacatcctggccactgagctgtattgatttccataatcatcccccaggctgaggcagggccacactagaattctggtgcctatttaggcatcatctctcttttgccttataggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425926 - DNA, 1676 bp, Homo sapiens
ctccaggcgggaggcgacgcctgcgcagtgcggtcgcggggctgtcgttgtcccgcgagccgccgaccaggcctcgaacgggatggcagaggtgagcaccctgatgaaggccacggtcctgatgcggcagcctgggcgggtgcaggagatcgtgggcgccctccgcaagggcggcggagaccggttacaggtacctctggggcgtgcgggggccggccgggctgggggcggctggagaggcttcctgcccattgggccttcccgctttgctctgccgcggacccctcctagctctctgccccaagaaatggctgggagcttgaaggagagcgggttggttcgcctgtcctaaaacccaaatttcagatttctcaatatggtcatgctgcttcctctaattggacagaaggcgcccacaccagtacctagggccgatattatcctccccaagccagcggctccccagtgatttctgattttgacatgaccttgagcaggtttgcatataatggaaagcgatgcccttcttcttacaatattctggataatagcaagatcatcagtgaggagtgtcggaaagagtagagacagggtttcgccatgttggccaggctggactcgaactcctgacctcaagtgatccacctgcctcagcctcctaaagcactgggattgcagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425927 - DNA, 1369 bp, Homo sapiens
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggccagtagccgccccctcgcgcaccccggccccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425928 - DNA, 1215 bp, Homo sapiens
ctccaggcgggaggcgacgcctgcgcagtgcggtcgcggggctgtcgttgtcccgcgagccgccgaccaggcctcgaacgggatggcagaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatgggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425929 - DNA, 1210 bp, Homo sapiens
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatgtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425930 - DNA, 370 bp, Homo sapiens
ctgcggtttacagagtctcgtccttctcagcacgatgtcataggagtcatgtagcgctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425931 - DNA, 391 bp, Homo sapiens
atgtccccaaaggaaaacttgaagaaaatttcatgtaacactctcttagatgaagttgcatcttctttttatttgagacacagttttactctgtggcccaggctggagtgcagtggtgtgatctcgtcttggctcactgcaacctccgcctcctgggttcaaacgattctcatttttcagcctcctgagtagctgggattaaaggcgcatgccactacaccggctaatttttgtattttttagtagagacagggtttcgccatgttggccaggctggactcgaactcctgacctcaagtgatccacctgcctcagcctcctaaagcactgggattgcaggtgtgagccaccgcccctggccatgaagttgcctcttctaggtgactttttt

SEQ ID NO: 425932 - DNA, 332 bp, Homo sapiens
cctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttc

SEQ ID NO: 425933 - DNA, 1469 bp, Homo sapiens
cgaataatggataggtagcgaggcctgggaggtgaggagggaggaagcgtccggagtggggcgggcccggactccgacccccggggcgcttcgagccccccagctggtcaccgaggcaccgccgcttcacccaggccagtagccgccccctcgcgcaccccggccccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425934 - DNA, 1658 bp, Homo sapiens
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggccagtagccgccccctcgcgcaccccggccccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaatttttaaaatgaaaaaaaagctgctctgattcaggggatgtgggtcggggtagaacctggacctcttggccctgggggcacatgggatgcttctaggaacacagtttgagaaccaccacaaattgg

SEQ ID NO: 425935 - DNA, 1361 bp, Homo sapiens
gggggcacaaaaaacttctggctaggtcgaggctgggtttgaatcggccgaggcggcccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425936 - DNA, 1631 bp, Homo sapiens
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggccagtagccgccccctcgcgcaccccggccccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacagatttctcaatatggtcatgctgcttcctctaattggacagaaggcgcccacaccagtacctagggccgatattatcctccccaagccagcggctccccagtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425937 - DNA, 1305 bp, Homo sapiens
ctccaggcgggaggcgacgcctgcgcagtgcggtcgcggggctgtcgttgtcccgcgagccgccgaccaggcctcgaacgggatggcagaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425938 - DNA, 1404 bp, Homo sapiens
ctccaggcgggaggcgacgcctgcgcagtgcggtcgcggggctgtcgttgtcccgcgagccgccgaccaggcctcgaacgggatggcagaggtgagcaccctgatgaaggccacggtcctgatgcggcagcctgggcgggtgcaggagatcgtgggcgccctccgcaagggcggcggagaccggttacagatttctcaatatggtcatgctgcttcctctaattggacagaaggcgcccacaccagtacctagggccgatattatcctccccaagccagcggctccccagtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425939 - DNA, 1253 bp, Homo sapiens
agccctcctagctctcgccccaagaaaggctgggatgaaggagagcgtggccgttaaccatcagatctcaatggtcatgctgggttcctctagtggacagaaggcgcccacaccagtacctagggccgattatcctccaagccagggtcccaggatctgatttgatacctgagcaggtgcttatggaaaggatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425940 - DNA, 1118 bp, Homo sapiens
ccgcccctggccatgaagttgcctcttctaggtgacttttttctcatactaagctgtaggacgttgctgggaagaacttgatatggactaatggcctttctccccatttggatatcccagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425941 - DNA, 1166 bp, Homo sapiens
ctccaggcgggaggcgacgcctgcgcagtgcggtcgcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccaggccagtagccgccccctcgcgcaccccggccccgcctcacacgcgcgcccgagcgagccccgggctcccctcgggcccagcgtggcgcaggggtcagtggttctctcgggtctcgggacaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatgtgagccaaatcctgtttgggctgggaaaggacgaggggtggggaccaccagccagggcagttaactctgcatgaaccctaacctggggaagaaggggagggaagccactctagcttcttcaccctcaggcagttgtttatgggttactttttggccaggcgcggtggctcagacctgtaatcctagcactttgggaggccgaggcgggcggatcacttgaggtcaggagttcgagaccagcctggccaacatggtgaaagtccatctgtactaaaaatacagaaataagccg

SEQ ID NO: 425942 - DNA, 1005 bp, Homo sapiens
ctccaggcgggaggcgacgcctgcgcagtgcggtcgcggggctgtcgttgtcccgcgagccgccgaccaggcctcgaacgggatggcagaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatgtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaa

SEQ ID NO: 425943 - DNA, 799 bp, Homo sapiens
aacaagattaaaagacagatgacaaactaggaaaaaatttgtaaaacctgacagagggttttttgtctgatttttgggtatatatcttcatatacaaagcactcttaaaaactattaagaagtaatctctgaagacttccaatttccagtgtagcatgtaaggagctcagtaattgccacttggtcctgacaacaaataaataactgaacaaaatgaagaatagacaacacttcttagattcctcagataagtgaagtcacagggcaaaccacatcctccaaaactggagagacagacagctggatacagagaatcacaactactgaagcagaaaccgaggatcagaaacccctgagggaaccagtacccgggtaggaaaatctgagctgtaattgaggagttgctggaggctcagtgtggacaagtctgagacctaaaagctccagggagagccagtcctaaggaagcccccgtagttttgtgagatttacttcctggagctctaccaggtcctcacagtaaatatttgagaaaaatcctcttacgctgtcagctggagaagggagaagtgaaacattttgaaatacaccaaggtattctgttcttaacaaggcctgccctcaggagaaattatttctcttagaaccaaacctaactggggaatgggaaaaatgcagctccagtcaactctagccctccacatggagaaaaggaaattcctaactccacctccctctagacttccagttgtgggaagggaaataacttcagccctctccagccatccctgttccattt

SEQ ID NO: 425944 - DNA, 1722 bp, Homo sapiens
gaggtccgggatcctgggggtcctgcccgccgcccgccaggggtttggcccttcccctctgcggcgctagcctagaagagggtgggacgttctgggctcagggggtgggggacgtttgccggtcactgctgctggcgccctgactgttgccgtcctccagccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgtttgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425945 - DNA, 426 bp, Homo sapiens
tgggcgcatggcagaggcacaggcacgccatggcctggctctctgcgtttcctcgtgggagggggtttatgtggccgaagcaggccctggtgtggatggatctggcctcccaggtattgagggagcacggggtgcgcctgtttcctccacgcacgtcgcccatggcctccccaaggccctggcctcactccagatcccggggccacctccaggctccacgagcgccaactcccagcgccgtccagacccaggaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425946 - DNA, 2235 bp, Homo sapiens
gcaggctggtactggccccgggtgttatggtcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgtttgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425947 - DNA, 2158 bp, Homo sapiens
tagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgtttgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425948 - DNA, 1898 bp, Homo sapiens
cccgttcgtgtctcaggagtgtcccgcgggcaggaaggctgaggccggtgaactctcatgtgcctgcctgtgctttttctccagtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgtttgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425949 - DNA, 1436 bp, Homo sapiens
tagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425950 - DNA, 1072 bp, Homo sapiens
  misc_feature (892)..(892): n is a, c, g, or t
  misc_feature (896)..(898): n is a, c, g, or t
  misc_feature (903)..(903): n is a, c, g, or t
  misc_feature (908)..(908): n is a, c, g, or t
  misc_feature (912)..(912): n is a, c, g, or t
  misc_feature (918)..(918): n is a, c, g, or t
  misc_feature (925)..(925): n is a, c, g, or t
  misc_feature (927)..(927): n is a, c, g, or t
  misc_feature (929)..(930): n is a, c, g, or t
  misc_feature (932)..(932): n is a, c, g, or t
  misc_feature (942)..(943): n is a, c, g, or t
  misc_feature (945)..(945): n is a, c, g, or t
  misc_feature (947)..(947): n is a, c, g, or t
tagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaacgggaaagagaccncgannngaggnggggngaancggcangaggaangngnngnaacccccggnngnancggcggcaccaaatggccgaaagacggcggccaagaaacccacccgggcggccccaacaacagaccacgacgggaccaagaccgcccccgccgacggcccacgcacacacaccccacacacaacc

SEQ ID NO: 425951 - DNA, 683 bp, Homo sapiens
gcggccgcctactactactactgctcgaattcaagcttctaacgatgtacgggcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgtttgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425952 - DNA, 261 bp, Homo sapiens
ctaactgaggagggtgtggggctgggcagccgccagctcctctcagccgggaggtctgcggcctgggcgcccctaacttcatgtggttcttaccggcagtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagt

SEQ ID NO: 425953 - DNA, 2259 bp, Homo sapiens
tagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgtttgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425954 - DNA, 2240 bp, Homo sapiens
  misc_feature (18)..(18): n is a, c, g, or t
  misc_feature (24)..(24): n is a, c, g, or t
tcggtctaggtcgaggcnggtgtnaatcggccgagtcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgtttgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425955 - DNA, 2219 bp, Homo sapiens
tagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgtttgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425956 - DNA, 1901 bp, Homo sapiens
gcaggctggtactggccccgggtgttatggtcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgtttgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425957 - DNA, 1627 bp, Homo sapiens
tagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaaagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgtttgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 425958 - DNA, 847 bp, Homo sapiens
gcaggctggtactggccccgggtgttatggtcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagaccccggccgtccggagcgctctgtgtccgttttactcttttctacacgccgttttgcgtcattccaataagtgggtgtgtgagggtctggcgctgtcaaccaggctggagtgcagtggcaccatcgtgactcactgcagccttgacctcctcacctcagatcttcccatctcagcctcctgagtagctgggactacagggtttcaccatgctgcccaggctggtcttgaactcctgacctcaagcaatctgcttgcctcagcctcctgaagggctgggattacagagtcttgccctgtcgccaggctggagtgcagtggcgcgatctcggctcaccacaacctgcgcctcccaggttcaagggattctcctgcctcagcctcccgagtagctgggactagagacacgcgccaccatgcccagctaattagctaatttttgtatttttagtggagacgtggtttcaccgtgttggccaggatggtctccatctcttgaccttgtgatccacctgccttggcctcccaaagtgctgggattacaggcatgagccactgctcccggcctttatttcttcttttaaaaaaaaaaaaaaaaa

SEQ ID NO: 425959 - DNA, 1710 bp, Homo sapiens
ctatgttgccgcccaggctggtctcaaattcctatgctcaaatgatcctcctgccttggcctcccaaagtgctgggattataggcatcagccactgtgcttggcctagcctagcattctctaaacaggtggttagaagcggtggataccaggcttctgacgatcaaattgtaaaaaaaggggtcaggtgttatctccagactgtggaattagattgtagtagaatatattttacctacaaacattttgacctcacccaagagtaaggctctcttttttttcttttttaatgaaaaaagaaaggagaatatttgctatcttatcttaaaaaaatagatccttaggtgattacaattttaaaataagaattgagagcccttactatgcacagtcctttaagttcataaagcttgatcccaactctgggagatggggcaggacaggtgttaatgtccctgcctttagcagatgaagaaaccaggctctgagaggagaagctacttgcccaaggcctgaaggcctctgaaagaggagcagagctcagggcacctggccctccttggtcccctctctactccacggtgctgctactcagggtcatctcaaaactatgtaaaggcagatgttgccaatccacaggcttcagggactcttatcaagactcatcccaacttttaaggcacactttcacaccgctcacattgtgcattacattttggagtccttgttggaagtgaactttccgcctgtaagcctgccattccatgtctaatatattgggatggcatcaccttctgtactatgcagcagaaggagactggcctgggattctggaaacatgagatccatttgcatattaatccccggctcgctgtgtgaccctgagcaagtctccttcactttctgtgcctcagtgtccttatttgagtaaaaagggaataaaactagatgagtggttttcaaactttaaaacactggaagctctctttgaaaacaaaagatgagaattgaaatggatggcactggaagctgttcttgtctactggggtttggagctgccaggggacctgctcacatccactcctcactcagcccctcccgcccctcccttctccacgcactgtgactgacttccatgtgtgaaggcctgcagttaattctcctgtgtcttgaatggttgggagatgagttggtcagacccttagtgaaatgatgtgggaaggaacaggaatgctgtggctctgaagaaggtagtagaacatcccacacctgctaataagcacattttgcaaactcagttgactcacctcagatttgcctagtgaaaactgaagggctggatgtagacccagagagcagggtggacagagcccatgctggaagtactgagcatcaggactgtatggggctggctttagcatcatcattctgtgcaaagacaaaataattaatgtcacactgtctgaaattttcaccaaaaccaaaaaggcgcattaacatgattgttccaacctcatggtttttcaagtgtgagcgcccagagacctcttcagaggctaagagagcatgcgctgccacagctgttagcatttggagacgtaattacaatgcccccactccccgcaccaaacctgggtttttctaccgtttttgtagatgtcatgatgtcacgacccctgcaccctgaaaaaaataaatgtttttaaggaca

SEQ ID NO: 425960 - DNA, 3538 bp, Homo sapiens
cctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgtcggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacacccaaaaaagctg

SEQ ID NO: 425961 - DNA, 3392 bp, Homo sapiens
  misc_feature (1)..(1): n is a, c, g, or t
nctcaagtgactcgtaagcgatcccggatcagcacgcgctatcaatcttatcagttcttgacttggaataacgctgggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgtcggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacacccaaaaaagctg

SEQ ID NO: 425962 - DNA, 3474 bp, Homo sapiens
cctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgtcggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacacccaaaaaagctg

SEQ ID NO: 425963 - DNA, 3156 bp, Homo sapiens
cctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgtcggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttcgatctaaactcagtgtgtgtgtgtgtgtctgtgtgtgtctgtgtgtgtgtgtgtgtgtgtggtcttcctctcatatccaaagctactagcactgaggaagttgg

SEQ ID NO: 425964 - DNA, 3096 bp, Homo sapiens
cctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgtcggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccattttttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacacccaaaaaagctg

SEQ ID NO: 425965 - DNA, 2200 bp, Homo sapiens
  misc_feature (32)..(32): n is a, c, g, or t
  misc_feature (38)..(39): n is a, c, g, or t
tgcagtactaccgcggttttaggtgcgaggcngggtgnngcagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacacccaaaaaagctg

SEQ ID NO: 425966 - DNA, 3351 bp, Homo sapiens
cctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgtcggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttcctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacacccaaaaaagctg

SEQ ID NO: 425967 - DNA, 954 bp, Homo sapiens
cctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgcctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacacccaaaaaagctg

SEQ ID NO: 425968 - DNA, 2166 bp, Homo sapiens
acggacggaagctccattgagccaaataagttggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 425969 - DNA, 2723 bp, Homo sapiens
acggacggaagctccattgagccaaataagttggtgagaaggttcccgacgcggcgatggcgagaagcagagaaatggacctggggaggggcgtgcggggtgcggtagggttggatggaagccttggcgggccaaaaccactgcggcttcaaaatccggatgcgccggtatttgaggcggaggcggggctgtggggggaggagggaggctatggcgctcagagcactgtgggacactgtaggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaaaaaaaaaaaaaaaaaaaaaaagaaaataaaaaaaaacaaaagataaagaaaaaagaacaaaaaaaaaaggcaaaaagaaacaaaaaagaacaacaacagaaaacaaaccgcgaacaacacgacgcaacaaacacaactacatagaaccacaaaaacaaaaatagaaaaaagagagaaggcagacaaacaaactagaaacaaagactaaacacaaaaagaacaaaaagaagggcgtggagcgcgagcaccaaagtagggctcgagacgaccggagacaaagaagcaggagcacaactctaaccgagaacctacacgagctacgctactagcgagcgaactagccacgaga

SEQ ID NO: 425970 - DNA, 2348 bp, Homo sapiens
acggacggaagctccattgagccaaataagttggtgagaaggttcccgacgcggcgatggcgagaagcagagaaatggacctggggaggggcgtgcggggtgcggtagggttggatggaagccttggcgggccaaaaccactgcggcttcaaaatccggatgcgccggtatttgaggcggaggcggggctgtggggggaggagggaggctatggcgctcagagcactgtgggacactgtaggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 425971 - DNA, 2210 bp, Homo sapiens
acggacggaagctccattgagccaaataagttggtgagaaggttcccgacgcggcgatggcgagaagcagagaaatggacctggggaggggcgtgcggggtgcggtagggttggatggaagccttggcgggccaaaaccactgcggcttcaaaatccggatgcgccggtatttgaggcggaggcggggctgtggggggaggagggaggctatggcgctcagagcactgtgggacactgtaggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccacacccagcccatccttgtacttttagtagagatgggtttcaccacgttggtctcgaactcctgaccccaagcgatccatcccgcctccacctccctaagtgctgggattacatggcatgagtcaccactcccagcattcatgtctgaagattctatagtggatactttatagt

SEQ ID NO: 425972 - DNA, 1722 bp, Homo sapiens
ggagagaagagtcagtaggcgggcgcgggtggtaattcaggcgacggggcactgactgtaaatgatgactcggaagagcaagacaagagcagggatgaggacaatgatgaagacgaagaaaggctggaagaagaagaacagaatgaagaggaagaagtagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 425973 - DNA, 1555 bp, Homo sapiens
ccggtctggtaccgcccagcgagtattggatatcgtcgatccacgcgctccggtttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 425974 - DNA, 1861 bp, Homo sapiens
acggacggaagctccattgagccaaataagttggtgagaaggttcccgacgcggcgatggcgagaagcagagaaatggacctggggaggggcgtgcggggtgcggtagggttggatggaagccttggcgggccaaaaccactgcggcttcaaaatccggatgcgccggtatttgaggcggaggcggggctgtggggggaggagggaggctatggcgctcagagcactgtgggacactgtaggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 425975 - DNA, 1217 bp, Homo sapiens
acggacggaagctccattgagccaaataagttggtgagaaggttcccgacgcggcgatggcgagaagcagagaaatggacctggggaggggcgtgcggggtgcggtagggttggatggaagccttggcgggccaaaaccactgcggcttcaaaatccggatgcgccggtatttgaggcggaggcggggctgtggggggaggagggaggctatggcgctcagagcactgtgggacactgtaggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 425976 - DNA, 2374 bp, Homo sapiens
acggacggaagctccattgagccaaataagttggtgagaaggttcccgacgcggcgatggcgagaagcagagaaatggacctggggaggggcgtgcggggtgcggtagggttggatggaagccttggcgggccaaaaccactgcggcttcaaaatccggatgcgccggtatttgaggcggaggcggggctgtggggggaggagggaggctatggcgctcagagcactgtgggacactgtaggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 425977 - DNA, 2088 bp, Homo sapiens
  misc_feature (14)..(14): n is a, c, g, or t
tggcgcggcgccancaaactatgactaggtacgaggccgggtgttgggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 425978 - DNA, 2461 bp, Homo sapiens
acggacggaagctccattgagccaaataagttggtgagaaggttcccgacgcggcgatggcgagaagcagagaaatggacctggggaggggcgtgcggggtgcggtagggttggatggaagccttggcgggccaaaaccactgcggcttcaaaatccggatgcgccggtatttgaggcggaggcggggctgtggggggaggagggaggctatggcgctcagagcactgtgggacactgtaggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcggtgagcagctcggggggggcggacgaacgggcaggagggaagcaggtgctggaacggcagctttgctcacccccggtctcctcgcagctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 425979 - DNA, 2111 bp, Homo sapiens
acggacggaagctccattgagccaaataagttggtgagaaggttcccgacgcggcgatggcgagaagcagagaaatggacctggggaggggcgtgcggggtgcggtagggttggatggaagccttggcgggccaaaaccactgcggcttcaaaatccggatgcgccggtatttgaggcggaggcggggctgtggggggaggagggaggctatggcgctcagagcactgtgggacactgtaggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaatttgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 425980 - DNA, 1754 bp, Homo sapiens
acggacggaagctccattgagccaaataagttggtgagaaggttcccgacgcggcgatggcgagaagcagagaaatggacctggggaggggcgtgcggggtgcggtagggttggatggaagccttggcgggccaaaaccactgcggcttcaaaatccggatgcgccggtatttgaggcggaggcggggctgtggggggaggagggaggctatggcgctcagagcactgtgggacactgtaggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgtttgcttcatcaatctgaaggttatggccttttgacaagagggattctgaacgactaaattagtcagtttgctcgcttttgtttacttaaatgtatggttagatggttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 425981 - DNA, 3392 bp, Homo sapiens
ttttttggcggagtgaccacatagagtaaaaagaatgtaaccctctttggttttatgtgttttggctcaggttggacatacttatataaatgtgattgacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaagaagtaactccagcttgtctggatggaaaaagcttgagagcaggcattacagaagtgaaggagcctagtgtcacctcacctacaccatcagacatacagcagaacaaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaagtaagggaatatgactccggcctctagaaggctcatcttaaatttgtaagaaccatggtacagagacctgattagtttttggtattgtgctccaataatgtcatagttttaagagataatttttatgagaattgactaagaaccagtatccttcaactacttcatcaatgtttggtataatataaaagcacactatcatctgaaaaagctattaaatacccctctttttccaaatatctacctgtgtgaagccaggttttacaacatgtattgcagcaagttgaatgcagaagcaggtatggtaattcagctgccttctatcaagctaaacattaaagagatttgtagaactataaaacaatgctactctccttaccaaattgttttagaaaatagctttataggctaacattattgttaattgtcatttaattgttttgtcatttaaaatattttaaattgttttctgttagtttcttttttgtatattctatgggtattttattgatacatgatagttgtacatttttatggggtgcatgtgatattttgatatgtgcatacaatgtgtagcaatcaaatcagggtaattgggatattcatcacctcaaacatttatcatttatttgtgttggaaacattcaaaccttttcttctagctatttatccattgttggatacttatatcaattctatatcttagctgttgtgaatagagctgcaataaatgtaggagtgcagataaaaaaaaaata

SEQ ID NO: 425982 - DNA, 3549 bp, Homo sapiens
gccaggacacacgaacattgtggttcccatcctttggatgaattcgacgtacctttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggaattacctgtgagagaagagccttcaaatgataatgttatcaaacagcaaagcgatcatctagcagttccatcgtctgcagagttacattatatggcagcttcagttactaatgctgttcccccacataattttaagagtcaagaagtaactccagcttgtctggatggaaaaagcttgagagcaggcattacagaagtgaaggagcctagtgtcacctcacctacaccatcagacatacagcagaacaaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaagtaagggaatatgactccggcctctagaaggctcatcttaaatttgtaagaaccatggtacagagacctgattagtttttggtattgtgctccaataatgtcatagttttaagagataatttttatgagaattgactaagaaccagtatccttcaactacttcatcaatgtttggtataatataaaagcacactatcatctgaaaaagctattaaatacccctctttttccaaatatctacctgtgtgaagccaggttttacaacatgtattgcagcaagttgaatgcagaagcaggtatggtaattcagctgccttctatcaagctaaacattaaagagatttgtagaactataaaacaatgctactctccttaccaaattgttttagaaaatagctttataggctaacattattgttaattgtcatttaattgttttgtcatttaaaatattttaaattgttttctgttagtttcttttttgtatattctatgggtattttattgatacatgatagttgtacatttttatggggtgcatgtgatattttgatatgtgcatacaatgtgtagcaatcaaatcagggtaattgggatattcatcacctcaaacatttatcatttatttgtgttggaaacattcaaaccttttcttctagctatttatccattgttggatacttatatcaattctatatcttagctgttgtgaatagagctgcaataaatgtaggagtgcagataaaaaaaaaata

SEQ ID NO: 425983 - DNA, 3472 bp, Homo sapiens
cttccattgagttaggtactgtgctgctgggctcctggtaatctgttagcttctcaatgattacttccaatgttttattatatttaagaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggaattacctgtgagagaagagccttcaaatgataatgttatcaaacagcaaagcgatcatctagcagttccatcgtctgcagagttacattatatggcagcttcagttactaatgctgttcccccacataattttaagagtcaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaagtaagggaatatgactccggcctctagaaggctcatcttaaatttgtaagaaccatggtacagagacctgattagtttttggtattgtgctccaataatgtcatagttttaagagataatttttatgagaattgactaagaaccagtatccttcaactacttcatcaatgtttggtataatataaaagcacactatcatctgaaaaagctattaaatacccctctttttccaaatatctacctgtgtgaagccaggttttacaacatgtattgcagcaagttgaatgcagaagcaggtatggtaattcagctgccttctatcaagctaaacattaaagagatttgtagaactataaaacaatgctactctccttaccaaattgttttagaaaatagctttataggctaacattattgttaattgtcatttaattgttttgtcatttaaaatattttaaattgttttctgttagtttcttttttgtatattctatgggtattttattgatacatgatagttgtacatttttatggggtgcatgtgatattttgatatgtgcatacaatgtgtagcaatcaaatcagggtaattgggatattcatcacctcaaacatttatcatttatttgtgttggaaacattcaaaccttttcttctagctatttatccattgttggatacttatatcaattctatatcttagctgttgtgaatagagctgcaataaatgtaggagtgcagataaaaaaaaaata

SEQ ID NO: 425984 - DNA, 2146 bp, Homo sapiens
ataaatgatgcttaattctttgtctacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaagtaagggaatatgactccggcctctagaaggctcatcttaaatttgtaagaaccatggtacagagacctgattagtttttggtattgtgctccaataatgtcatagttttaagagataatttttatgagaattgactaagaaccagtatccttcaactacttcatcaatgtttggtataatataaaagcacactatcatctgaaaaagctattaaatacccctctttttccaaatatctacctgtgtgaagccaggttttacaacatgtattgcagcaagttgaatgcagaagcaggtatggtaattcagctgccttctatcaagctaaacattaaagagatttgtagaactataaaacaatgctactctccttaccaaattgttttagaaaatagctttataggctaacattattgttaattgtcatttaattgttttgtcatttaaaatattttaaattgttttctgttagtttcttttttgtatattctatgggtattttattgatacatgatagttgtacatttttatggggtgcatgtgatattttgatatgtgcatacaatgtgtagcaatcaaatcagggtaattgggatattcatcacctcaaacatttatcatttatttgtgttggaaacattcaaaccttttcttctagctatttatccattgttggatacttatatcaattctatatcttagctgttgtgaatagagctgcaataaatgtaggagtgcagataaaaaaaaaata

SEQ ID NO: 425985 - DNA, 3361 bp, Homo sapiens
ttttttggcggagtgaccacatagagtaaaaagaatgtaaccctctttggttttatgtgttttggctcaggttggacatacttatataaatgtgattgacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaagaagtaactccagcttgtctggatggaaaaagcttgagagcaggcattacagaagtgaaggagcctagtgtcacctcacctacaccatcagacatacagcagaacaaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctgtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaagtaagggaatatgactccggcctctagaaggctcatcttaaatttgtaagaaccatggtacagagacctgattagtttttggtattgtgctccaataatgtcatagttttaagagataatttttatgagaattgactaagaaccagtatccttcaactacttcatcaatgtttggtataatataaaagcacactatcatctgaaaaagctattaaatacccctctttttccaaatatctacctgtgtgaagccaggttttacaacatgtattgcagcaagttgaatgcagaagcaggtatggtaattcagctgccttctatcaagctaaacattaaagagatttgtagaactataaaacaatgctactctccttaccaaattgttttagaaaatagctttataggctaacattattgttaattgtcatttaattgttttgtcatttaaaatattttaaattgttttctgttagtttcttttttgtatattctatgggtattttattgatacatgatagttgtacatttttatggggtgcatgtgatattttgatatgtgcatacaatgtgtagcaatcaaatcagggtaattgggatattcatcacctcaaacatttatcatttatttgtgttggaaacattcaaaccttttcttctagctatttatccattgttggatacttatatcaattctatatcttagctgttgtgaatagagctgcaataaatgtaggagtgcagataaaaaaaaaata

SEQ ID NO: 425986 - DNA, 2334 bp, Homo sapiens
ttttttggcggagtgaccacatagagtaaaaagaatgtaaccctctttggttttatgtgttttggctcaggttggacatacttatataaatgtgattgacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaagaagtaactccagcttgtctggatggaaaaagcttgagagcaggcattacagaagtgaaggagcctagtgtcacctcacctacaccatcagacatacagcagaacaaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttg

SEQ ID NO: 425987 - DNA, 1966 bp, Homo sapiens
ttttttggcggagtgaccacatagagtaaaaagaatgtaaccctctttggttttatgtgttttggctcaggttggacatacttatataaatgtgattgacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaagaagtaactccagcttgtctggatggaaaaagcttgagagcaggcattacagaagtgaaggagcctagtgtcacctcacctacaccatcagacatacagcagaacaaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagaggagagaatcaacatggtcacagttttctaataaatcgacctggaaaagtcaccatatatgtccaaaccgagttatatccataagaggaagtctctttggcaacctcagctcactttgccttatcga

SEQ ID NO: 425988 - DNA, 1285 bp, Homo sapiens
ttttttggcggagtgaccacatagagtaaaaagaatgtaaccctctttggttttatgtgttttggctcaggttggacatacttatataaatgtgattgacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaagaagtaactccagcttgtctggatggaaaaagcttgagagcaggcattacagaagtgaaggagcctagtgtcacctcacctacaccatcagacatacagcagaacaaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccagtactttgccattcttccatttcactatcatattcatcggcgttaatctaactttcttcccacaacact

SEQ ID NO: 425989 - DNA, 962 bp, Homo sapiens
  misc_feature (876)..(876): n is a, c, g, or t
  misc_feature (878)..(878): n is a, c, g, or t
  misc_feature (886)..(886): n is a, c, g, or t
  misc_feature (891)..(891): n is a, c, g, or t
  misc_feature (895)..(895): n is a, c, g, or t
  misc_feature (899)..(899): n is a, c, g, or t
tgccgtcgttgttggccacagcgtgggaagcagctctgggggagctcggagctcccgatcacggcttcttgggggtagctacggctgggtgtgtagaacggggccggggctggggctgggtcccctagtggagacccaagtgcgagaggcaagaactctgcagcttcctgccttctgggtcagttccttattcaagttgctactgctggcatcatttacaggccggtgccccgcgggtgagctggagacctcagacgtggtaactgtggtgctgggccaggacgcaaaactgccctgcttctaccgaggggactccggcgagcaagtggggcaagtggcatgggctcgggtggacgcgggcgaaggcgcccaggaactagcgctactgcactccaaatacgggcttcatgtgagcccggcttacgagggccgcgtggagcagccgccgcccccacgcaaccccctggacggctcagtgctcctgcgcaacgcagtgcaggcggatgagggcgagtacgagtgccgggtcagcaccttccccgccggcagcttccaggcgcggctgcggctccgagtgctggtgcctcccctgccctcactgaatcctggtccagcactagaagagggccagggcctgaccctggcagcctcctgcacagctgagggcagcccagcccccagcgtgacctgggacacggaggtcaaaggcacaacgtccagccgttccttcaagcactcccgctctgctgccgtcacctcagagttccacttggtgcctagccgcagcatgaatgggcagccactgacttgtgtggtgtcccatcctggcctgctccaggaccaaaggatcacccacatcctccacgtgtcctcctngngagcctgnagggnttgnaacnaattttgcatggggaagggcttgtcctgcttgatgggcccctctaatggggggttggcttcgg

SEQ ID NO: 425990 - DNA, 3454 bp, Homo sapiens
tgccgtcgttgttggccacagcgtgggaagcagctctgggggagctcggagctcccgatcacggcttcttgggggtagctacggctgggtgtgtagaacggggccggggctggggctgggtcccctagtggagacccaagtgcgagaggcaagaactctgcagcttcctgccttctgggtcagttccttattcaagtctgcagccggctcccagggagatctcggtggaacttcagaaacgctgggcagtctgcctttcaaccatgcccctgtccctgggagccgagatgtgggggcctgaggcctggctgctgctgctgctactgctggcatcatttacaggccggtgccccgcgggtgagctggagacctcagacgtggtaactgtggtgctgggccaggacgcaaaactgccctgcttctaccgaggggactccggcgagcaagtggggcaagtggcatgggctcgggtggacgcgggcgaaggcgcccaggaactagcgctactgcactccaaatacgggcttcatgtgagcccggcttacgagggccgcgtggagcagccgccgcccccacgcaaccccctggacggctcagtgctcctgcgcaacgcagtgcaggcggatgagggcgagtacgagtgccgggtcagcaccttccccgccggcagcttccaggcgcggctgcggctccgagtgctggtgcctcccctgccctcactgaatcctggtccagcactagaagagggccagggcctgaccctggcagcctcctgcacagctgagggcagcccagcccccagcgtgacctgggacacggaggtcaaaggcacaacgtccagccgttccttcaagcactcccgctctgctgccgtcacctcagagttccacttggtgcctagccgcagcatgaatgggcagccactgacttgtgtggtgtcccatcctggcctgctccaggaccaaaggatcacccacatcctccacgtgtccttccttgctgaggcctctgtgaggggccttgaagaccaaaatctgtggcacattggcagagaaggagctatgctcaagtgcctgagtgaagggcagccccctccctcatacaactggacacggctggatgggcctctgcccagtggggtacgagtggatggggacactttgggctttcccccactgaccactgagcacagcggcatctacgtctgccatgtcagcaatgagttctcctcaagggattctcaggtcactgtggatgttcttgacccccaggaagactctgggaagcaggtggacctagtgtcagcctcggtggtggtggtgggtgtgatcgccgcactcttgttctgccttctggtggtggtggtggtgctcatgtcccgataccatcggcgcaaggcccagcagatgacccagaaatatgaggaggagctgaccctgaccagggagaactccatccggaggctgcattcccatcacacggaccccaggagccagccggaggagagtgtagggctgagagccgagggccaccctgatagtctcaaggacaacagtagctgctctgtgatgagtgaagagcccgagggccgcagttactccacgctgaccacggtgagggagatagaaacacagactgaactgctgtctccaggctctgggcgggccgaggaggaggaagatcaggatgaaggcatcaaacaggccatgaaccattttgttcaggagaatgggaccctacgggccaagcccacgggcaatggcatctacatcaatgggcggggacacctggtctgacccaggcctgcctcccttccctaggcctggctccttctgttgacatgggagattttagctcatcttgggggcctccttaaacacccccatttcttgcggaagatgctccccatcccactgactgcttgacctttacctccaacccttctgttcatcgggagggctccaccaattgagtctctcccaccatgcatgcaggtcactgtgtgtgtgcatgtgtgcctgtgtgagtgttgactgactgtgtgtgtgtggaggggtgactgtccgtggaggggtgactgtgtccgtggtgtgtattatgctgtcatatcagagtcaagtgaactgtggtgtatgtgccacgggatttgagtggttgcgtgggcaacactgtcagggtttggcgtgtgtgtcatgtggctgtgtgtgacctctgcctgaaaaagcaggtattttctcagaccccagagcagtattaatgatgcagaggttggaggagagaggtggagactgtggctcagacccaggtgtgcgggcatagctggagctggaatctgcctccggtgtgagggaacctgtctcctaccacttcggagccatgggggcaagtgtgaagcagccagtccctgggtcagccagaggcttgaactgttacagaagccctctgccctctggtggcctctgggcctgctgcatgtacatattttctgtaaatatacatgcgccgggagcttcttgcaggaatactgctccgaatcacttttaatttttttcttttttttttcttgccctttccattagttgtattttttatttatttttatttttatttttttttagagatggagtctcactatgttgctcaggctggccttgaactcctgggctcaagcaatcctcctgcctcagcctccctagtagctgggactttaagtgtacaccactgtgcctgctttgaatcctttacgaagagaaaaaaaaaattaaagaaagcctttagatttatccaatgtttactactgggattgcttaaagtgaggcccctccaacaccagggggttaattcctgtgattgtgaaaggggctacttccaaggcatcttcatgcaggcagccccttgggagggcacctgagagctggtagagtctgaaattagggatgtgagcctcgtggttactgagtaaggtaaaattgcatccaccattgtttgtgataccttagggaattgcttggacctggtgacaagggctcctgttcaatagtggtgttggggagagagagagcagtgattatagaccgagagagtaggagttgaggtgaggtgaaggaggtgctgggggtgagaatgtcgcctttccccctgggttttggatcactaattcaaggctcttctggatgtttctctgggttggggctggagttcaatgaggtttatttttagctggcccacccagatacactcagccagaatacctagatttagtacccaaactcttcttagtctgaaatctgctggatttctggcctaagggagaggctcccatccttcgttccccagccagcctaggacttcgaatgtggagcctgaagatctaagatcctaacatgtacattttatgtaaatatgtgcatatttgtacataaaatgatattctgtttttaaataaacagacaaa

SEQ ID NO: 425991 - DNA, 3138 bp, Homo sapiens
tgccgtcgttgttggccacagcgtgggaagcagctctgggggagctcggagctcccgatcacggcttcttgggggtagctacggctgggtgtgtagaacggggccggggctggggctgggtcccctagtggagacccaagtgcgagaggcaagaactctgcagcttcctgccttctgggtcagttccttattcaagtctgcagccggctcccagggagatctcggtggaacttcagaaacgctgggcagtctgcctttcaaccatgcccctgtccctgggagccgagatgtgggggcctgaggcctggctgctgctgctgctactgctggcatcatttacaggccggtgccccgcgggtgagctggagacctcagacgtggtaactgtggtgctgggccaggacgcaaaactgccctgcttctaccgaggggactccggcgagcaagtggggcaagtggcatgggctcgggtggacgcgggcgaaggcgcccaggaactagcgctactgcactccaaatacgggcttcatgtgagcccggcttacgagggccgcgtggagcagccgccgcccccacgcaaccccctggacggctcagtgctcctgcgcaacgcagtgcaggcggatgagggcgagtacgagtgccgggtcagcaccttccccgccggcagcttccaggcgcggctgcggctccgagtgctggtgcctcccctgccctcactgaatcctggtccagcactagaagagggccagggcctgaccctggcagcctcctgcacagctgagggcagcccagcccccagcgtgacctgggacacggaggtcaaaggcacaacgtccagccgttccttcaagcactcccgctctgctgccgtcacctcagagttccacttggtgcctagccgcagcatgaatgggcagccactgacttgtgtggtgtcccatcctggcctgctccaggaccaaaggatcacccacatcctccacgtgtccttccttgctgaggcctctgtgaggggccttgaagaccaaaatctgtggcacattggcagagaaggagctatgctcaagtgcctgagtgaagggcagccccctccctcatacaactggacacggctggatgggcctctgcccagtggggtacgagtggatggggacactttgggctttcccccactgaccactgagcacagcggcatctacgtctgccatgtcagcaatgagttctcctcaagggattctcaggtcactgtggatgttcttgacccccaggaagactctgggaagcaggtggacctagtgtcagcctcggtggtggtggtgggtgtgatcgccgcactcttgttctgccttctggtggtggtggtggtgctcatgtcccgataccatcggcgcaaggcccagcagatgacccagaaatatgaggaggagctgaccctgaccagggagaactccatccggaggctgcattcccatcacacggaccccaggagccagccggaggagagtgtagggctgagagccgagggccaccctgatagtctcaaggacaacagtagctgctctgtgatgagtgaagagcccgagggccgcagttactccacgctgaccacggtgagggagatagaaacacagactgaactgctgtctccaggctctgggcgggccgaggaggaggaagatcaggatgaaggcatcaaacaggccatgaaccattttgttcaggagaatgggaccctacgggccaagcccacgggcaatggcatctacatcaatgggcggggacacctggtctgacccaggcctgcctcccttccctaggcctggctccttctgttgacatgggagattttagctcatcttgggggcctccttaaacacccccatttcttgcggaagatgctccccatcccactgactgcttgacctttacctccaacccttctgttcatcgggagggctccaccaattgagtctctcccaccatgcatgcaggtcactgtgtgtgtgcatgtgtgcctgtgtgagtgttgactgactgtgtgtgtgtggaggggtgactgtccgtggaggggtgactgtgtccgtggtgtgtattatgctgtcatatcagagtcaagtgaactgtggtgtatgtgccacgggatttgagtggttgcgtgggcaacactgtcagggtttggcgtgtgtgtcatgtggctgtgtgtgacctctgcctgaaaaagcaggtattttctcagaccccagagcagtattaatgatgcagaggttggaggagagaggtggagactgtggctcagacccaggtgtgcgggcatagctggagctggaatctgcctccggtgtgagggaacctgtctcctaccacttcggagccatgggggcaagtgtgaagcagccagtccctgggtcagccagaggcttgaactgttacagaagccctctgccctctggtggcctctgggcctgctgcatgtacatattttctgtaaatatacatgcgccgggagcttcttgcaggaatactgctccgaatcacttttaatttttttcttttttttttcttgccctttccattagttgtattttttatttatttttatttttatttttttttagagatggagtctcactatgttgctcaggctggccttgaactcctgggctcaagcaatcctcctgcctcagcctccctagtagctgggactttaagtgtacaccactgtgcctgctttgaatcctttacgaagagaaaaaaaaaattaaagaaagcctttagatttatccaatgtttactactgggattgcttaaagtgaggcccctccaacaccagggggttaattcctgtgattgtgaaaggggctacttccaaggcatcttcatgcaggcagccccttgggagggcacctgagagctggtagagtctgaaattagggatgtgagcctcgtggttactgagtaaggtaaaattgcatccaccattgtttgtgataccttagggaattgcttggacctggtgacaagggctcctgttcaatagtggtgttgggcgataacatcgccccacacggtagtggtggtggtgatggtgtcacgttgtactctttgtgctggtggtgttggcgatacatagcggga

SEQ ID NO: 425992 - DNA, 1816 bp, Homo sapiens
cgtattgaggatccgatcagagcataccctaggaggaggaagatcaggatgaaggcatcaaacaggccatgaaccattttgttcaggagaatgggaccctacgggccaagcccacgggcaatggcatctacatcaatgggcggggacacctggtctgacccaggcctgcctcccttccctaggcctggctccttctgttgacatgggagattttagctcatcttgggggcctccttaaacacccccatttcttgcggaagatgctccccatcccactgactgcttgacctttacctccaacccttctgttcatcgggagggctccaccaattgagtctctcccaccatgcatgcaggtcactgtgtgtgtgcatgtgtgcctgtgtgagtgttgactgactgtgtgtgtgtggaggggtgactgtccgtggaggggtgactgtgtccgtggtgtgtattatgctgtcatatcagagtcaagtgaactgtggtgtatgtgccacgggatttgagtggttgcgtgggcaacactgtcagggtttggcgtgtgtgtcatgtggctgtgtgtgacctctgcctgaaaaagcaggtattttctcagaccccagagcagtattaatgatgcagaggttggaggagagaggtggagactgtggctcagacccaggtgtgcgggcatagctggagctggaatctgcctccggtgtgagggaacctgtctcctaccacttcggagccatgggggcaagtgtgaagcagccagtccctgggtcagccagaggcttgaactgttacagaagccctctgccctctggtggcctctgggcctgctgcatgtacatattttctgtaaatatacatgcgccgggagcttcttgcaggaatactgctccgaatcacttttaatttttttcttttttttttcttgccctttccattagttgtattttttatttatttttatttttatttttttttagagatggagtctcactatgttgctcaggctggccttgaactcctgggctcaagcaatcctcctgcctcagcctccctagtagctgggactttaagtgtacaccactgtgcctgctttgaatcctttacgaagagaaaaaaaaaattaaagaaagcctttagatttatccaatgtttactactgggattgcttaaagtgaggcccctccaacaccagggggttaattcctgtgattgtgaaaggggctacttccaaggcatcttcatgcaggcagccccttgggagggcacctgagagctggtagagtctgaaattagggatgtgagcctcgtggttactgagtaaggtaaaattgcatccaccattgtttgtgataccttagggaattgcttggacctggtgacaagggctcctgttcaatagtggtgttggggagagagagagcagtgattatagaccgagagagtaggagttgaggtgaggtgaaggaggtgctgggggtgagaatgtcgcctttccccctgggttttggatcactaattcaaggctcttctggatgtttctctgggttggggctggagttcaatgaggtttatttttagctggcccacccagatacactcagccagaatacctagatttagtacccaaactcttcttagtctgaaatctgctggatttctggcctaagggagaggctcccatccttcgttccccagccagcctaggacttcgaatgtggagcctgaagatctaagatcctaacatgtacattttatgtaaatatgtgcatatttgtacataaaatgatattctgtttttaaataaacagacaaa

SEQ ID NO: 425993 - DNA, 431 bp, Homo sapiens
aacagcctgcggctctgggtgacgtcatgggggtggagggtggagagctgtctggacacgttgggtggtggtggcttcagcccttcccggctggcacccttcagcttccctgtcttccaggctggatgggcctctgcccagtggggtacgagtggatggggacactttgggctttcccccactgaccactgagcacagcggcatctacgtctgccatgtcagcaatgagttctcctcaagggattctcaggtcactgtggatgttcttggtaagcactggagcagaagtccttggtaaggacctgggccaagggcttggtgggggcagcaggaagcaagacagagacagtgaattgggaaagtgtttattcagagggggctgggctgtgtgtcttgcagagaatcaaactgaggtgtggttttagatgttt

SEQ ID NO: 425994 - DNA, 2676 bp, Homo sapiens
tgccgtcgttgttggccacagcgtgggaagcagctctgggggagctcggagctcccgatcacggcttcttgggggtagctacggctgggtgtgtagaacggggccggggctggggctgggtcccctagtggagacccaagtgcgagaggcaagaactctgcagcttcctgccttctgggtcagttccttattcaagtctgcagccggctcccagggagatctcggtggaacttcagaaacgctgggcagtctgcctttcaaccatgcccctgtccctgggagccgagatgtgggggcctgaggcctggctgctgctgctgctactgctggcatcatttacaggccggtgccccgcgggtgagctggagacctcagacgtggtaactgtggtgctgggccaggacgcaaaactgccctgcttctaccgaggggactccggcgagcaagtggggcaagtggcatgggctcgggtggacgcgggcgaaggcgcccaggaactagcgctactgcactccaaatacgggcttcatgtgagcccggcttacgagggccgcgtggagcagccgccgcccccacgcaaccccctggacggctcagtgctcctgcgcaacgcagtgcaggcggatgagggcgagtacgagtgccgggtcagcaccttccccgccggcagcttccaggcgcggctgcggctccgagtgctggtgcctcccctgccctcactgaatcctggtccagcactagaagagggccagggcctgaccctggcagcctcctgcacagctgagggcagcccagcccccagcgtgacctgggacacggaggtcaaaggcacaacgtccagccgttccttcaagcactcccgctctgctgccgtcacctcagagttccacttggtgcctagccgcagcatgaatgggcagccactgacttgtgtggtgtcccatcctggcctgctccaggaccaaaggatcacccacatcctccacgtgtccttccttgctgaggcctctgtgaggggccttgaagaccaaaatctgtggcacattggcagagaaggagctatgctcaagtgcctgagtgaagggcagccccctccctcatacaactggacacggctggatgggcctctgcccagtggggtacgagtggatggggacactttgggctttcccccactgaccactgagcacagcggcatctacgtctgccatgtcagcaatgagttctcctcaagggattctcaggtcactgtggatgttcttgacccccaggaagactctgggaagcaggtggacctagtgtcagcctcggtggtggtggtgggtgtgatcgccgcactcttgttctgccttctggtggtggtggtggtgctcatgtcccgataccatcggcgcaaggcccagcagatgacccagaaatatgaggaggagctgaccctgaccagggagaactccatccggaggctgcattcccatcacacggaccccaggagccagccggaggagagtgtagggctgagagccgagggccaccctgatagtctcaaggacaacagtagctgctctgtgatgagtgaagagcccgagggccgcagttactccacgctgaccacggtgagggagatagaaacacagactgaactgctgtctccaggctctgggcgggccgaggaggaggaagatcaggatgaaggcatcaaacaggccatgaaccattttgttcaggagaatgggaccctacgggccaagcccacgggcaatggcatctacatcaatgggcggggacacctggtctgacccaggcctgcctcccttccctaggcctggctccttctgttgacatgggagattttagctcatcttgggggcctccttaaacacccccatttcttgcggaagatgctccccatcccactgactgcttgacctttacctccaacccttctgttcatcgggagggctccaccaattgagtctctcccaccatgcatgcaggtcactgtgtgtgtgcatgtgtgcctgtgtgagtgttgactgactgtgtgtgtgtggaggggtgactgtccgtggaggggtgactgtgtccgtggtgtgtattatgctgtcatatcagagtcaagtgaactgtggtgtatgtgccacgggatttgagtggttgcgtgggcaacactgtcagggtttggcgtgtgtgtcatgtggctgtgtgtgacctctgcctgaaaaagcaggtattttctcagaccccagagcagtattaatgatgcagaggttggaggagagaggtggagactgtggctcagacccaggtgtgcgggcatagctggagctggaatctgcctccggtgtgagggaacctgtctcctaccacttcggagccatgggggcaagtgtgaagcagccagtccctgggtcagccagaggcttgaactgttacagaagccctctgccctctggtggcctctgggcctgctgcatgtacatattttctgtaaatatacatgcgccgggagcttcttgcaggaatactgctccgaatcacttttaatttttttcttttttttttcttgccctttccattagttgtattttttatttatttttatttttatttttttttagagatggagtccagcctggacgatatagccagaccctgtctgtaaaaaaaccaaaaccc

SEQ ID NO: 425995 - DNA, 3565 bp, Homo sapiens
tgccgtcgttgttggccacagcgtgggaagcagctctgggggagctcggagctcccgatcacggcttcttgggggtagctacggctgggtgtgtagaacggggccggggctggggctgggtcccctagtggagacccaagtgcgagaggcaagaactctgcagcttcctgccttctgggtcagttccttattcaagtctgcagccggctcccagggagatctcggtggaacttcagaaacgctgggcagtctgcctttcaaccatgcccctgtccctgggagccgagatgtgggggcctgaggcctggctgctgctgctgctactgctggcatcatttacaggccggtgccccgcgggtgagctggagacctcagacgtggtaactgtggtgctgggccaggacgcaaaactgccctgcttctaccgaggggactccggcgagcaagtggggcaagtggcatgggctcgggtggacgcgggcgaaggcgcccaggaactagcgctactgcactccaaatacgggcttcatgtgagcccggcttacgagggccgcgtggagcagccgccgcccccacgcaaccccctggacggctcagtgctcctgcgcaacgcagtgcaggcggatgagggcgagtacgagtgccgggtcagcaccttccccgccggcagcttccaggcgcggctgcggctccgagtgctggtgcctcccctgccctcactgaatcctggtccagcactagaagagggccagggcctgaccctggcagcctcctgcacagctgagggcagcccagcccccagcgtgacctgggacacggaggtcaaaggcacaacgtccagccgttccttcaagcactcccgctctgctgccgtcacctcagagttccacttggtgcctagccgcagcatgaatgggcagccactgacttgtgtggtgtcccatcctggcctgctccaggaccaaaggatcacccacatcctccacgtgtccttccttgctgaggcctctgtgaggggccttgaagaccaaaatctgtggcacattggcagagaaggagctatgctcaagtgcctgagtgaagggcagccccctccctcatacaactggacacggctggatgggcctctgcccagtggggtacgagtggatggggacactttgggctttcccccactgaccactgagcacagcggcatctacgtctgccatgtcagcaatgagttctcctcaagggattctcaggtcactgtggatgttcttgacccccaggaagactctgggaagcaggtggacctagtgtcagcctcggtggtggtggtgggtgtgatcgccgcactcttgttctgccttctggtggtggtggtggtgctcatgtcccgataccatcggcgcaaggcccagcagatgacccagaaatatgaggaggagctgaccctgaccagggagaactccatccggaggctgcattcccatcacacggaccccaggagccagccggaggagagtgtagggctgagagccgagggccaccctgatagtctcaaggacaacagtagctgctctgtgatgagtgaagagcccgagggccgcagttactccacgctgaccacggtgagggagatagaaacacagactgaactgctgtctccaggctctgggcgggccgaggaggaggaagatcaggatgaaggcatcaaacaggccatgaaccattttgttcaggagaatgggaccctacgggccaagcccacgggcaatggcatctacatcaatgggcggggacacctggtctgacccaggcctgcctcccttccctaggcctggctccttctgttgacatgggagattttagctcatcttgggggcctccttaaacacccccatttcttgcggaagatgctccccatcccactgactgcttgacctttacctccaacccttctgttcatcgggagggctccaccaattgagtctctcccaccatgcatgcaggtcactgtgtgtgtgcatgtgtgcctgtgtgagtgttgactgactgtgtgtgtgtggaggggtgactgtccgtggaggggtgactgtgtccgtggtgtgtattatgctgtcatatcagagtcaagtgaactgtggtgtatgtgccacgggatttgagtggttgcgtgggcaacactgtcagggtttggcgtgtgtgtcatgtggctgtgtgtgacctctgcctgaaaaagcaggtattttctcagaccccagagcagtattaatgatgcagaggttggaggagagaggtggagactgtggctcagacccaggtgtgcgggcatagctggagctggaatctgcctccggtgtgagggaacctgtctcctaccacttcggagccatgggggcaagtgtgaagcagccagtccctgggtcagccagaggcttgaactgttacagaagccctctgccctctggtggcctctgggcctgctgcatgtacatattttctgtaaatatacatgcgccgggagcttcttgcaggaatactgctccgaatcacttttaatttttttcttttttttttcttgccctttccattagttgtattttttatttatttttatttttatttttttttagagatggagtctcactatgttgctcaggctggccttgaactcctgggctcaagcaatcctcctgcctcagcctccctagtagctgggactttaagtgtacaccactgtgcctgctttgaatcctttacgaagagaaaaaaaaaattaaagaaagcctttagatttatccaatgtttactactgggattgcttaaagtgaggcccctccaacaccagggggttaattcctgtgattgtgaaaggggctacttccaaggcatcttcatgcaggcagccccttgggagggcacctgagagctggtagagtctgaaattagggatgtgagcctcgtggttactgagtaaggtaaaattgcatccaccattgtttgtgataccttagggaattgcttggacctggtgacaagggctcctgttcaatagtggtgttggggagagagagagcagtgattatagaccgagagagtaggagttgaggtgaggtgaaggaggtgctgggggtgagaatgtcgcctttccccctgggttttggatcactaattcaaggctcttctggatgtttctctgggttggggctggagttcaatgaggtttatttttagctggcccacccagatacactcagccagaatacctagatttagtacccaaactcttcttagtctgaaatctgctggatttctggcctaagggagaggctcccatccttcgttccccagccagcctaggacttcgaatgtggagcctgaagatctaagatcctaacatgtacattttatgtaaatatgtgcatatttgtacataaaatgatattctgtttttaaataaacagacaaaacttgttctgtctggctcctgtcttgccccttgaactgtgtaagctctgagtcacatactctctgtctcggtaccatccttcctgtagtcccaagtaggggaagacttagg

SEQ ID NO: 425996 - DNA, 219 bp, Homo sapiens
tctcccgtctccctctccccatgcctaacacttgttcctggtccccgatctctgggcccctatgcttctgaggcaaccgttacccctgcttacgcctggcctctgatcccaccatgacccagccatgccccaccatgtgcagctgccctgcctttgttcctgacttgccctttgcccttggtctccagagtgaagagcccgagggccgcagttactcca

SEQ ID NO: 425997 - DNA, 1742 bp, Homo sapiens
agcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 425998 - DNA, 1988 bp, Homo sapiens
agcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaaggtatgagcgcctagataagtggcttccagggaagaaacagggtggtgtgttgcctttgcctttaaaaaggagtggggtcttggggcagtagcaggaagcagttgccagaactgaatacttgggtctctcgggggagagaagttgggggttgaggttctgcatcttgggagggatctgatatttcaggcaggaagatgtaaggcagtgacttctgagacaaggcatctgcctttctattcttttcagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 425999 - DNA, 1923 bp, Homo sapiens
agcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacgggtgaggcgggacagagggcccctggaagaggaggttgggggtgagggaatgccagtttatgttcgtgtttacctggcagtctacagagctctctgacatttctcatgacacttgaaagaagggcttgagggagtctgggtgtgggggtggcctcctcatcctctttctatccctggctcagagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 426000 - DNA, 1893 bp, Homo sapiens
agcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacaggtatagacaggctccaagatgtcagaggctggcagctggtgatgacatgatggaaaagaaaaaggggcatccaaatctggggaagaaacagagggccgggttgtctggggcagtattctgagtccctacagtcaacccttgctccttgcagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 426001 - DNA, 2320 bp, Homo sapiens
agcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaaggtatgagcgcctagataagtggcttccagggaagaaacagggtggtgtgttgcctttgcctttaaaaaggagtggggtcttggggcagtagcaggaagcagttgccagaactgaatacttgggtctctcgggggagagaagttgggggttgaggttctgcatcttgggagggatctgatatttcaggcaggaagatgtaaggcagtgacttctgagacaaggcatctgcctttctattcttttcagaggaaatctcggcgttactaccccacacgcctggccatcaatctctcatcaggtgtctctggagctgggggcactgtgcatcagccaggtttcattgtcgtggaaaccaattaccgactgtatgcctacacgggtgaggcgggacagagggcccctggaagaggaggttgggggtgagggaatgccagtttatgttcgtgtttacctggcagtctacagagctctctgacatttctcatgacacttgaaagaagggcttgagggagtctgggtgtgggggtggcctcctcatcctctttctatccctggctcagagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacaggtatagacaggctccaagatgtcagaggctggcagctggtgatgacatgatggaaaagaaaaaggggcatccaaatctggggaagaaacagagggccgggttgtctggggcagtattctgagtccctacagtcaacccttgctccttgcagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 426002 - DNA, 1717 bp, Homo sapiens
agcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 426003 - DNA, 1272 bp, Homo sapiens
agcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaactgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 426004 - DNA, 964 bp, Homo sapiens
agcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaaagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 426005 - DNA, 805 bp, Homo sapiens
agcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacacagctgctcccaggcgggctccagggcctcatcctcaaccccattttccgccagaacctccgcattgcccttctgggtggggggaaggcctggtctgatgacacaagtcagctgggaccagacaacgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagca

SEQ ID NO: 426006 - DNA, 609 bp, Homo sapiens
agcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaagtaagtctcagccagatacaaatttctcaacagctacatttcccaaactgctgttccttggagcacttccaggaagtgttaatagatatatcccaaaacttaaaaataaatacatttgggaaactctgaatattgcc

SEQ ID NO: 426007 - DNA, 537 bp, Homo sapiens
agcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgatggagagcaccccttcaaggggactgaaccgagtacaccctgccacatgtctggctgtcttcagggagctcccatccttggctaagaactgggtgatgcggatgctctttctggagcagcctttgccacaggctgctgtagctctgtgggtaaagaaggaattcagcaagtaagtctcagccagatacaaatttctcaacagctacatttcccaaactgctgttccttggagcacttccaggaagtgttaatagatatatcccaaaacttaaaaataaatacatttgggaaactctgaatattgcc

SEQ ID NO: 426008 - DNA, 775 bp, Homo sapiens
attaaaccatgcatgcaaaatgcctagtgcgctgcctgctctgtgcccggcagctgctgttctcaccgtctccttaattcaccttgcccttcacctctgtgtggcacaccctctttcctaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagtaaaaaaaaataataaataaataaaaga

SEQ ID NO: 426009 - DNA, 1004 bp, Homo sapiens
ggcagcccaggcgccgggcgctgcctctacagctgtgtgtaggcctgggggcgagggtcttcggaacgtagcgctggctgcggccccgcccgcctacccacccgcccgtccggcagccggctcccgccgcctccgcgctctgtctggggccagccacctggcgggccgctccggtgcgcctgcccgcgcttttcactgacaggcgctgttccccacagccagcgccgcccgccacgtcccagctctcggccaacggagctgcgcggcgggtgacctttccgagcccagcgcgatgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaagtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactgatgaactactaagtaaaacaacaatacactctatctaaaaaactccagggggcactctattggcagggggcggcgaacaacagcgggtcttgaaatgggcgccattgtggcataacggtggtcccttggccccactgtttctgtggtccccatgttggtaactctcgccgggtcccccataaaggagccgatataattcattaagccattgacctggtaagg

SEQ ID NO: 426010 - DNA, 484 bp, Homo sapiens
agacccgattatgatgctagtacgcctcacaaacggccgccccagcccctcactccacgccaagcaccttccctttgggctgggcttgcaggagcccttctcgcactgcccagaccggtctgccttgtgagcgactggactccaggacatcccgggaactctgggcagagggactggacgtgaggctcttcatgagcagaagccagcagaccggccacatgatgaccacactgacttgtgcaagtgactgttctcacctctctttttttcttcctacaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagtaaaaaaaaataataaataaataaaaga

SEQ ID NO: 426011 - DNA, 1928 bp, Homo sapiens
ggcagcccaggcgccgggcgctgcctctacagctgtgtgtaggcctgggggcgagggtcttcggaacgtagcgctggctgcggccccgcccgcctacccacccgcccgtccggcagccggctcccgccgcctccgcgctctgtctggggccagccacctggcgggccgctccggtgcgcctgcccgcgcttttcactgacaggcgctgttccccacagccagcgccgcccgccacgtcccagctctcggccaacggagctgcgcggcgggtgacctttccgagcccagcgcgatgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaaattggtggccatttatgaagttttaaaggatgatgaacgaaggcagaggatgaactactaagtagaaaaaagagagaaaagaaaaaaaagactggcagcaagagtgtggatgtatcaaaactcggtgcttcagaaaaaaatgaaagattgctgatgaaaccacagtggcatgatttgcttccatgcaaactggggatttggttttgccttacactaaaagcattacctcacctcatccaggatgctgggcagttttatgctaaatataaagaaacaagattgaaggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagtaaaaaaaaataataaataaataaaaga

SEQ ID NO: 426012 - DNA, 986 bp, Homo sapiens
tgaacttaccatagaaatgtgcacacattagactctcagtaagtacttgttaagttaatcaagcacccaattagtcatggtgacctctgctgagagagcataatcttgggaagagtgggagacaagatcctggtctctaaaggttgggagacttgaattctaggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagtaaaaaaaaataataaataaataaaaga

SEQ ID NO: 426013 - DNA, 2094 bp, Homo sapiens
ggcagcccaggcgccgggcgctgcctctacagctgtgtgtaggcctgggggcgagggtcttcggaacgtagcgctggctgcggccccgcccgcctacccacccgcccgtccggcagccggctcccgccgcctccgcgctctgtctggggccagccacctggcgggccgctccggtgcgcctgcccgcgcttttcactgacaggcgctgttccccacagccagcgccgcccgccacgtcccagctctcggccaacggagctgcgcggcgggtgacctttccgagcccagcgcgatgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaaattggtggccatttatgaagttttaaaggatgatgaacgaaggcagaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggatgaactactaagtagaaaaaagagagaaaagaaaaaaaagactggcagcaagagtgtggatgtatcaaaactcggtgcttcagaaaaaaatgaaagattgctgatgaaaccacagtggcatgatttgcttccatgcaaactggggatttggttttgccttacactaaaagcattacctcacctcatccaggatgctgggcagttttatgctaaatataaagaaacaagattgaaggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagtaaaaaaaaataataaataaataaaaga

SEQ ID NO: 426014 - DNA, 1615 bp, Homo sapiens
tctgggcgttgattagtagtagttactggttgaacattgtttgttggtgtgtatattgtaattgagattgctcgggggaataggttatgtgattaggagtagggttaggatgagtgggaagaagaaagagaggaagtaaagtttaattatgcctttttgggttgagatgatgaacgaaggcagaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggatgaactactaagtagaaaaaagagagaaaagaaaaaaaagactggcagcaagagtgtggatgtatcaaaactcggtgcttcagaaaaaaatgaaagattgctgatgaaaccacagtggcatgatttgcttccatgcaaactggggatttggttttgccttacactaaaagcattacctcacctcatccaggatgctgggcagttttatgctaaatataaagaaacaagattgaaggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagtaaaaaaaaataataaataaataaaaga

SEQ ID NO: 426015 - DNA, 1305 bp, Homo sapiens
tagcggatcttaaacaccgcatctacctggaacaacaacttgatgaactactaagtagaaaaaagagagaaaagaaaaaaaagactggcagcaagagtgtggatgtatcaaaactcggtgcttcagaaaaaaatgaaagattgctgatgaaaccacagtggcatgatttgcttccatgcaaactggggatttggttttgccttacactaaaagcattacctcacctcatccaggatgctgggcagttttatgctaaatataaagaaacaagattgaaggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagtaaaaaaaaataataaataaataaaaga

SEQ ID NO: 426016 - DNA, 2455 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426017 - DNA, 743 bp, Homo sapiens
gggcaaccagccaggacagatggacctcccttccctccctctactgccctctctactccaaatccccagggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccgttcctccactcatctgtttctccggttctcactgtgcccatccaccggttgaccgccacatcctgcctttatcagagggactgtccccgtcgacatgttcaggcatagttacgccgcgtgccac

SEQ ID NO: 426018 - DNA, 2417 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaagggcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426019 - DNA, 2713 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtaaggttttccctcagctcctcccattttgcccctcctccctgcctcgctgtcccacattcatcccttccttcctcacctcacttttccttcactttttcctctcagcttccctgctgcttcaccctccattcctccttttccatgcctcctcaccgttccctgaaccctccattcttttccttctccctccttgagcccccattcctattctcccttatcaccgctattcatccccccaacctggcctccttgcaggtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426020 - DNA, 2595 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaaggttggggtgtcagactgagggggcggaccatgtgggaacatcagtgggccagtgggggacagatttgttgtctgggtggtgtcttgggagggcatgcagcgcacatccacagttccctccatttgtgctcatccctccagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426021 - DNA, 2853 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaaggttggggtgtcagactgagggggcggaccatgtgggaacatcagtgggccagtgggggacagatttgttgtctgggtggtgtcttgggagggcatgcagcgcacatccacagttccctccatttgtgctcatccctccagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtaaggttttccctcagctcctcccattttgcccctcctccctgcctcgctgtcccacattcatcccttccttcctcacctcacttttccttcactttttcctctcagcttccctgctgcttcaccctccattcctccttttccatgcctcctcaccgttccctgaaccctccattcttttccttctccctccttgagcccccattcctattctcccttatcaccgctattcatccccccaacctggcctccttgcaggtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426022 - DNA, 2671 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggaggagcaagcaggggcgcagcagagcagggcctgtactttgtccttcccagccttattgttccttccattccatgcagagcaacgagggtgacagtgatgacacagacctgcagatcttctgtgtttcctgtgggcaccccatcaacccacgtgttgccttgcgccacatggagcgctgctacgccaaggttggggtgtcagactgagggggcggaccatgtgggaacatcagtgggccagtgggggacagatttgttgtctgggtggtgtcttgggagggcatgcagcgcacatccacagttccctccatttgtgctcatccctccagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426023 - DNA, 2363 bp, Homo sapiens
gggaggggttcggcggtggaggtcggtcggttggcaacagtggggtctgtcggccgactcaggggtctgtggtgagccataaccggagtctgtggactgaacggcgggagtctatgggcagaatgatgaaccatctgggagttctatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426024 - DNA, 2541 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggggtctgtggtgagccataaccggagtctgtggactgaacggcgggagtctatgggcagaatgatgaaccatctgggagttctatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426025 - DNA, 1935 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccatgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426026 - DNA, 2003 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagactcaaacctctaatcacatggtcagtctgtctggtgaccagccccagctctgagtcatcacaccttctagcataagctcaggtgtgatcccatggcctcacaatacaagacactcctattaccctgaaatgtcaaccactgaaagtctccctca

SEQ ID NO: 426027 - DNA, 2548 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccaggtgagtggctgcataaagtgaatggatgtgtaaagtggttccgtttcagccctgcctgggtccatgatttctgttctgggccccctcctgcagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426028 - DNA, 1820 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagtcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426029 - DNA, 2219 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426030 - DNA, 1999 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatgcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426031 - DNA, 1854 bp, Homo sapiens
ctccccaaaccgaaaaaaaattcccttacctttcccccaggacaaaaagcccccctttttcgtgggtttggggggcccccaaaacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426032 - DNA, 1767 bp, Homo sapiens
tagcggggaggtgtgtctggggaggtaaggccaggccaggtgggtagggctagggcaaggccgccctccatccacctggggctgacctgggccttcctcctgccggcacaggaatcgtacaagtacttcccttcctcggtgagtccagccccccagggtggggtggggcatgcgggcagggcggtcagggccagtcctgagattctgccctgcagctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426033 - DNA, 1347 bp, Homo sapiens
taagaccgagcgaggagggaaatgggaggagggagaagatacaggaggaggaaggagacagagatgagagaagagggagatggagaggaggagggagatgggaggagggagaagatacaggaggaggaaggagctggggaggaagggagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426034 - DNA, 1179 bp, Homo sapiens
ggcacgagagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctggtgagcagacaggagcatccactggtggaa

SEQ ID NO: 426035 - DNA, 1111 bp, Homo sapiens
  misc_feature (75)..(75): n is a, c, g, or t
agaagatgaagtagagcccttacacgatggagttaaaaaggcagagaaaaagatgaagaagaaggtgtgagtgtnagtgaaatggagagcaccaccaatacatgtattggtggtgctcgccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaaggttggggtgtcagactgagggggcggaccatgtgggaacatcagtgggccagtgggggacagatttgttgtctgggtggtgtcttgggagggcatgcagcgcacatccacagttccctccatttgtgctcatccctccagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426036 - DNA, 713 bp, Homo sapiens
gggcaaccagccaggacagatggacctcccttccctccctctactgccctctctactccaaatccccagggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaag

SEQ ID NO: 426037 - DNA, 394 bp, Homo sapiens
accattccgccagtcacctatttacttctccttttgccatttgcgtctattttgccattctcacttactgatcacctcactcattctgttgcttgctaccttccctgcagccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggaggagcaagcaggggcgcagcagagcagggcctgtactttgtccttcccagccttattgttccttccattccatgcag

SEQ ID NO: 426038 - DNA, 2190 bp, Homo sapiens
  misc_feature (957)..(957): n is a, c, g, or t
  misc_feature (1196)..(1196): n is a, c, g, or t
  misc_feature (1239)..(1239): n is a, c, g, or t
gagctcacggtcgtcaggggtcctcaaggattcagagaacccccaaatgtcagggctgctcccttcttgtcctgcctctctgctcacacccttggacaggaggaagcacacgggaggcactcagagaacgtttgtggaatgaataaataaaagcatattttgagggaataaagaagcagaaaaacaaagaagaatctggggaagatgggcataaatctccaccaagtgctgccaaggcttcccaggcgaggctgctgaaaagaccctgtggaggtagagggacaatttgtcatggatgggaatgggcttgagggccgggaagcagggcatgatggggcctcattcatcattttcccgttatcccagcggcgtgcaggggagcaggtacagcacctgccaagtgagtgaccagagggggactgggaatggaaaggacctcaaggaaggacaagctgagctctgggaggccacctcctccaggaagccttccctgattcatccttcacaggcagtctcaatttgcagtcagatatccactgctctgattcttagatcggcaagtatctccctacccagactgcaggctctgctggggccgcggctgtttctgacttgtgcacaatggcatccctgtacctagcacaggactgagtccagagaaagtgctcagtgatgcttgttggccttgtctctcctctgtgggcagcactggacagggcacccggcgggtcctgagggtgtggacatcccacggcagagcctgcggttgatcccgaccatgaaccaaggcctggggcgggggtggccacatcaggccacttctgccaggagagatgtggctgtgagctgggggtctggcctgtccccggaggcattccttgggtttgcatccatcagaagatccactggttgcctctatttgggcctggagcagggatgggatttttccaaggtacntggggtctaggggagacccaggcccattattagggtcggtcttgagaaggcagagatcaggccaccactttatttggtgtagctcctcgctccattggtgtgtgctgagtgaatgaatgcatcagggactcctgcttcctgcccagagccccctccgcaccccacacagccttgctccaaggagaaggggtcagagccaactggacagtgctacagcatggggagcctcgaccaggctnggccctcgacgatgggataggcagacagccccctgtgcaaggnagctagcttgcagggtcccgagaggccaaaggccctggtctttcctggggcaagaggctgctgagaaggtgcacagagcctgggtgcaggaaaccatccagaatgctgcttcccgccatctgtgagatcttcgttttctctaacactcaaaaatagatgtttctgttatgctctctcgttggcaggggagcggcaggacctgccaaggcctgggggagcccgccagcctgctgagttctactgtacaaacagttggggagggggcgctgtctctgttaacttgaaattccccgatcagtaaacatgccaatttaaagtgtaattaactcaggccggaaaaaattcagatttggactgcttttcacagttgagcggctgctctgcctgggataaacacatttcaagagtctcagtccccgctttgccaccatctcctcctctgatctcctttcctgcttcaaaagactccagaatcttctcggttctcagagaaggctgaatccacctatgacctagtgggagcaccctgtgccgaaactgtttaccttctggtccccggagccatgggtcacgacctgggcctcatgtaggcccgctcctcagcagaccccaatctgcggcttctcccacctcactggggaagaaggagagccctggggatgtggagaagccaccccccaccccgccacatcccccacatcttacagaatctcgattgaatccccgggggcacatccctcagcaggacagcaacagtctttgccgcggcctggggagggctgtgctggggatgagcgccgagtggccgtggactaagtgaaggaaatgaccatgctcttctcccagctggatggcgaggccgggcaggaaccgcggaattcctgctcttcgttttcaaacactttgctgtcaagctatttgaataataaatacacattataaaaatgtaaa

SEQ ID NO: 426039 - DNA, 2520 bp, Homo sapiens
  misc_feature (957)..(957): n is a, c, g, or t
  misc_feature (1196)..(1196): n is a, c, g, or t
  misc_feature (1239)..(1239): n is a, c, g, or t
gagctcacggtcgtcaggggtcctcaaggattcagagaacccccaaatgtcagggctgctcccttcttgtcctgcctctctgctcacacccttggacaggaggaagcacacgggaggcactcagagaacgtttgtggaatgaataaataaaagcatattttgagggaataaagaagcagaaaaacaaagaagaatctggggaagatgggcataaatctccaccaagtgctgccaaggcttcccaggcgaggctgctgaaaagaccctgtggaggtagagggacaatttgtcatggatgggaatgggcttgagggccgggaagcagggcatgatggggcctcattcatcattttcccgttatcccagcggcgtgcaggggagcaggtacagcacctgccaagtgagtgaccagagggggactgggaatggaaaggacctcaaggaaggacaagctgagctctgggaggccacctcctccaggaagccttccctgattcatccttcacaggcagtctcaatttgcagtcagatatccactgctctgattcttagatcggcaagtatctccctacccagactgcaggctctgctggggccgcggctgtttctgacttgtgcacaatggcatccctgtacctagcacaggactgagtccagagaaagtgctcagtgatgcttgttggccttgtctctcctctgtgggcagcactggacagggcacccggcgggtcctgagggtgtggacatcccacggcagagcctgcggttgatcccgaccatgaaccaaggcctggggcgggggtggccacatcaggccacttctgccaggagagatgtggctgtgagctgggggtctggcctgtccccggaggcattccttgggtttgcatccatcagaagatccactggttgcctctatttgggcctggagcagggatgggatttttccaaggtacntggggtctaggggagacccaggcccattattagggtcggtcttgagaaggcagagatcaggccaccactttatttggtgtagctcctcgctccattggtgtgtgctgagtgaatgaatgcatcagggactcctgcttcctgcccagagccccctccgcaccccacacagccttgctccaaggagaaggggtcagagccaactggacagtgctacagcatggggagcctcgaccaggctnggccctcgacgatgggataggcagacagccccctgtgcaaggnagctagcttgcagggtcccgagaggccaaaggccctggtctttcctggggcaagaggctgctgagaaggtgcacagagcctgggtgcaggaaaccatccagaatgctgcttcccgccatctgtgagatcttcgttttctctaacactcaaaaatagatgtttctgttatgctctctcgttggcaggggagcggcaggacctgccaaggcctgggggagcccgccagcctgctgagttctactgtacaaacagttggggagggggcgctgtctctgttaacttgaaattccccgatcagtaaacatgccaatttaaagtgtaattaactcaggccggaaaaaattcagatttggactgcttttcacagttgaggttgtttttcttttatttatttatctctttccgggtgtggtggtatctgtggctggttttagccaggaaaaatagaagggggaccgggtggggagggggctggttgggagaggaaaggctggaaggaaaggaagagaaacgggcgggtggcctgacacccagcagccaggtgtctataggttttctgtcctgggagggggctgtcagggtgatgcccgcctgcagagagggggtcattctgcgaggttgggctgcagacccctgtgccagcgggcctggtgattcggaaatgatggggcactgtggagagaccccaggaaaacacccagtgctgcttttgacattctctctccatctcccctttcagcggctgctctgcctgggataaacacatttcaagagtctcagtccccgctttgccaccatctcctcctctgatctcctttcctgcttcaaaagactccagaatcttctcggttctcagagaaggctgaatccacctatgacctagtgggagcaccctgtgccgaaactgtttaccttctggtccccggagccatgggtcacgacctgggcctcatgtaggcccgctcctcagcagaccccaatctgcggcttctcccacctcactggggaagaaggagagccctggggatgtggagaagccaccccccaccccgccacatcccccacatcttacagaatctcgattgaatccccgggggcacatccctcagcaggacagcaacagtctttgccgcggcctggggagggctgtgctggggatgagcgccgagtggccgtggactaagtgaaggagggatgagcataaggagggatgagcataaggggggatgagcataaggagggatgagcataaggagggatgagcataaggatggagtaccg

SEQ ID NO: 426040 - DNA, 2557 bp, Homo sapiens
  misc_feature (957)..(957): n is a, c, g, or t
  misc_feature (1196)..(1196): n is a, c, g, or t
  misc_feature (1239)..(1239): n is a, c, g, or t
gagctcacggtcgtcaggggtcctcaaggattcagagaacccccaaatgtcagggctgctcccttcttgtcctgcctctctgctcacacccttggacaggaggaagcacacgggaggcactcagagaacgtttgtggaatgaataaataaaagcatattttgagggaataaagaagcagaaaaacaaagaagaatctggggaagatgggcataaatctccaccaagtgctgccaaggcttcccaggcgaggctgctgaaaagaccctgtggaggtagagggacaatttgtcatggatgggaatgggcttgagggccgggaagcagggcatgatggggcctcattcatcattttcccgttatcccagcggcgtgcaggggagcaggtacagcacctgccaagtgagtgaccagagggggactgggaatggaaaggacctcaaggaaggacaagctgagctctgggaggccacctcctccaggaagccttccctgattcatccttcacaggcagtctcaatttgcagtcagatatccactgctctgattcttagatcggcaagtatctccctacccagactgcaggctctgctggggccgcggctgtttctgacttgtgcacaatggcatccctgtacctagcacaggactgagtccagagaaagtgctcagtgatgcttgttggccttgtctctcctctgtgggcagcactggacagggcacccggcgggtcctgagggtgtggacatcccacggcagagcctgcggttgatcccgaccatgaaccaaggcctggggcgggggtggccacatcaggccacttctgccaggagagatgtggctgtgagctgggggtctggcctgtccccggaggcattccttgggtttgcatccatcagaagatccactggttgcctctatttgggcctggagcagggatgggatttttccaaggtacntggggtctaggggagacccaggcccattattagggtcggtcttgagaaggcagagatcaggccaccactttatttggtgtagctcctcgctccattggtgtgtgctgagtgaatgaatgcatcagggactcctgcttcctgcccagagccccctccgcaccccacacagccttgctccaaggagaaggggtcagagccaactggacagtgctacagcatggggagcctcgaccaggctnggccctcgacgatgggataggcagacagccccctgtgcaaggnagctagcttgcagggtcccgagaggccaaaggccctggtctttcctggggcaagaggctgctgagaaggtgcacagagcctgggtgcaggaaaccatccagaatgctgcttcccgccatctgtgagatcttcgttttctctaacactcaaaaatagatgtttctgttatgctctctcgttggcaggggagcggcaggacctgccaaggcctgggggagcccgccagcctgctgagttctactgtacaaacagttggggagggggcgctgtctctgttaacttgaaattccccgatcagtaaacatgccaatttaaagtgtaattaactcaggccggaaaaaattcagatttggactgcttttcacagttgaggttgtttttcttttatttatttatctctttccgggtgtggtggtatctgtggctggttttagccaggaaaaatagaagggggaccgggtggggagggggctggttgggagaggaaaggctggaaggaaaggaagagaaacgggcgggtggcctgacacccagcagccaggtgtctataggttttctgtcctgggagggggctgtcagggtgatgcccgcctgcagagagggggtcattctgcgaggttgggctgcagacccctgtgccagcgggcctggtgattcggaaatgatggggcactgtggagagaccccaggaaaacacccagtgctgcttttgacattctctctccatctcccctttcagcggctgctctgcctgggataaacacatttcaagagtctcagtccccgctttgccaccatctcctcctctgatctcctttcctgcttcaaaagactccagaatcttctcggttctcagagaaggctgaatccacctatgacctagtgggagcaccctgtgccgaaactgtttaccttctggtccccggagccatgggtcacgacctgggcctcatgtaggcccgctcctcagcagaccccaatctgcggcttctcccacctcactggggaagaaggagagccctggggatgtggagaagccaccccccaccccgccacatcccccacatcttacagaatctcgattgaatccccgggggcacatccctcagcaggacagcaacagtctttgccgcggcctggggagggctgtgctggggatgagcgccgagtggccgtggactaagtgaaggaaatgaccatgctcttctcccagctggatggcgaggccgggcaggaaccgcggaattcctgctcttcgttttcaaacactttgctgtcaagctatttgaataataaatacacattataaaaatgtaaa

SEQ ID NO: 426041 - DNA, 4049 bp, Homo sapiens
cttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtg

SEQ ID NO: 426042 - DNA, 4188 bp, Homo sapiens
cttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgaaaaaaaaaaaacacagaaaaaaaacacaacacacaaaaaccaaccccaacccacaaagggggggccgcccaccaaaaaaccccgcggggcacccccaccaaccacccccccccccgtcttggcaacagaggcgccccc

SEQ ID NO: 426043 - DNA, 4418 bp, Homo sapiens
cttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgctctcgggttgtgtgtctgttcacttttcctccctcagtgccctcattttatgtcattaaatggggctcacaaaccatgcaaatgctatgagatgcatggagggctgccctgtaccccagcacttgtgttgtctggtggtggcaccatctctgattttcaaagctttttccagaggctattattttcactgtagaatgatttcatgctatctctgtgtgcacaaatatttattttctttctgtaaccataacaacttcatatatgaggacttgtgtctctgtgcttttaaatgcataaatgcattataggatcatttgttggaatgaattaaataaacccttcctggggcatctggcgaatcccaaatg

SEQ ID NO: 426044 - DNA, 3966 bp, Homo sapiens
cttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgaaaaaaaaaaaacacagaaaaaaaacacaacacacaaaaaccaaccccaacccacaaagggggggccgcccaccaaaaaaccccgcggggcacccccaccaaccacccccccccccgtcttggcaacagaggcgccccc

SEQ ID NO: 426045 - DNA, 1731 bp, Homo sapiens
actagaactgccgattctgtctccagtgttctcttcacttgatccggagccgccaggcacggtgtagcacgcgtatattgggtgcgcgcctacgtccattctcgtgcgctagatcgcttgtaccctcgctgggctatggtgcatgatctatatactcatttcacttttttctgtctaccgtcatttcatggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgaaaaaaaaaaaacacagaaaaaaaacacaacacacaaaaaccaaccccaacccacaaagggggggccgcccaccaaaaaaccccgcggggcacccccaccaaccacccccccccccgtcttggcaacagaggcgccccc

SEQ ID NO: 426046 - DNA, 3989 bp, Homo sapiens
cttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtg

SEQ ID NO: 426047 - DNA, 2569 bp, Homo sapiens
cttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgactcgtggaaatgtccacgggccggcatatggcatacagattcataaagtggtgactcgtggaaatgtccaccaacccgggcgacctcgtgctcgaggatcg

SEQ ID NO: 426048 - DNA, 2345 bp, Homo sapiens
gtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagggctatgtgacctttgaggatgtggctgtctacttctcccaggaggaatggagattgcttgatgacgctcagaggctcctctaccgcaatgtgatgctggagaactttacacttctggcctctctgggacttgcgtcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaacagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccattacagagactgaa

SEQ ID NO: 426049 - DNA, 811 bp, Homo sapiens
gccctcatggttgcgttacatgggctacctagggatctgttcactgatttagagggtcccagagctctgggtcgggactgaggtgaaagagcggaaaaacgcgagaagcggtgttccttctacacagaggctagagtgcggatcggctgagtcggctgcaggcgcccctgcctccgtcagcgtccaggtgaccgccgttcccgccccgctcttccctgggtggactggaggaggccgcgccgatgaacctgaccgaggccgaaagaatgagggtcgtgatcaactcagtatgccactggaggctatatgagtaaacagcaaaccgtttctcatgaaagcaggatgttggcaaactgacaaactgcgtctgccacccagaaggaatgctgaaggcagtcacgacccaggcacaagtgtttcttgtgattaggcataattgaagcctgttaacaataatgtgaacttgtgatcaattaagcagctgaccagtcgttacctcctcctccctttcatcctacccaataaatgtggagggctgtggaagctcaggggctgcctttgctcactagaagcagggagctctcttcttccccagttcgccttctttaaaacagtttctttcgtcttaagttttcatttctacgttcgtcccccttcattcagtctcgtaatgatggtctcaagtagtaacagtaactgtcgtagtgatggtctcaagtagtaactgtacaagtctgccacatcttcccacagggtccattgcagtggcagcaatgcataaggaccctgcacaggtaagtcaaggatttct

SEQ ID NO: 426050 - DNA, 741 bp, Homo sapiens
gccctcatggttgcgttacatgggctacctagggatctgttcactgatttagagggtcccagagctctgggtcgggactgaggtgaaagagcggaaaaacgcgagaagcggtgttccttctacacagaggctagagtgcggatcggctgagtcggctgcaggcgcccctgcctccgtcagcgtccaggccgaaagaatgagggtcgtgatcaactcagtatgccactggaggctatatgagtaaacagcaaaccgtttctcatgaaagcaggatgttggcaaactgacaaactgcgtctgccacccagaaggaatgctgaaggcagtcacgacccaggcacaagtgtttcttgtgattaggcataattgaagcctgttaacaataatgtgaacttgtgatcaattaagcagctgaccagtcgttacctcctcctccctttcatcctacccaataaatgtggagggctgtggaagctcaggggctgcctttgctcactagaagcagggagctctcttcttccccagttcgccttctttaaaacagtttctttcgtcttaagttttcatttctacgttcgtcccccttcattcagtctcgtaatgatggtctcaagtagtaacagtaactgtcgtagtgatggtctcaagtagtaactgtacaagtctgccacatcttcccacagggtccattgcagtggcagcaatgcataaggaccctgcacaggtaagtcaaggatttct

SEQ ID NO: 426051 - DNA, 2320 bp, Homo sapiens
gccctcatggttgcgttacatgggctacctagggatctgttcactgatttagagggtcccagagctctgggtcgggactgaggtgaaagagcggaaaaacgcgagaagcggtgttccttctacacagaggctagagtgcggatcggctgagtcggctgcaggcgcccctgcctccgtcagcgtccaggtgaccgccgttcccgccccgctcttccctgggtggactggaggaggccgcgccgatgaacctgaccgagggctatgtgacctttgaggatgtggctgtctacttctcccaggaggaatggagattgcttgatgacgctcagaggctcctctaccgcaatgtgatgctggagaactttacacttctggcctctctgggacttgcgtcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaacagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccattacagagactgaa

SEQ ID NO: 426052 - DNA, 794 bp, Homo sapiens
gtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagggctatgtgacctttgaggatgtggctgtctacttctcccaggaggaatggagattgcttgatgacgctcagaggctcctctaccgcaatgtgatgctggagaactttacacttctggcctctctgggacttgcgtcttccaagacccatgaaataacccagctggagtcatgggaggagcccttcatgcctgcttgggaagttgtgacttcagccataccgagagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccattacagagactgaa

SEQ ID NO: 426053 - DNA, 885 bp, Homo sapiens
gccctcatggttgcgttacatgggctacctagggatctgttcactgatttagagggtcccagagctctgggtcgggactgaggtgaaagagcggaaaaacgcgagaagcggtgttccttctacacagaggctagagtgcggatcggctgagtcggctgcaggcgcccctgcctccgtcagcgtccaggtgaccgccgttcccgccccgctcttccctgggtggactggaggaggccgcgccgatgaacctgaccgaggtgcgtgcagcgtcccaggccgccccgcccaacccctcctcccagtgctgaagtcccaaggagccgccctgcaggccgaaagaatgagggtcgtgatcaactcagtatgccactggaggctatatgagtaaacagcaaaccgtttctcatgaaagcaggatgttggcaaactgacaaactgcgtctgccacccagaaggaatgctgaaggcagtcacgacccaggcacaagtgtttcttgtgattaggcataattgaagcctgttaacaataatgtgaacttgtgatcaattaagcagctgaccagtcgttacctcctcctccctttcatcctacccaataaatgtggagggctgtggaagctcaggggctgcctttgctcactagaagcagggagctctcttcttccccagttcgccttctttaaaacagtttctttcgtcttaagttttcatttctacgttcgtcccccttcattcagtctcgtaatgatggtctcaagtagtaacagtaactgtcgtagtgatggtctcaagtagtaactgtacaagtctgccacatcttcccacagggtccattgcagtggcagcaatgcataaggaccctgcacaggtaagtcaaggatttct

SEQ ID NO: 426054 - DNA, 471 bp, Homo sapiens
cggccgccctgagggaccccgctcaggtgagcgccgcgtcctcctggcctcccccgaatcctaaagccctgtgagggccgcctgctcaggtccccgggtgcagaactgtggggcgttcgtgcgcggcgtcccgtttctgacacgcagtgtgatggggtggcaatggagggcaaggggcccggctcgcaaagatgtgaggcgcattcagcgagtcccgaacctgaggcctcctggtgtctgtagtgggcagcttgggaagggacgaggcgcgtgtcgagcgacagcccgagcagctgcgctttcatcctgagggggccacagtggccgcggagggctggagacagaagagtgacaagatctgtttctcaaagtttgccaaaggcccttcaagtcaaaacagactggggtgggggtgaggcgggtgaagacagacctgtgagtaggtaaattcagtagactagtggagagtct

SEQ ID NO: 426055 - DNA, 665 bp, Homo sapiens
ggctacctagggatctgttcactgatttagagggtcccagagctctgggtcgggactgaggtgaaagagcggaaaaacgcgagaagcggtgttccttctacacagaggctagagtgcggatcggctgagtcggctgcaggcgcccctgcctccgtcagcgtccaggtgaccgccgttcccgccccgctcttccctgggtggactggaggaggccgcgccgatgaacctgaccgaggtgcgtgcagcgtcccaggccgccccgcccaacccctcctcccagtgctgaagtcccaaggagccgccctgcaggttaggcccttgtgtctctaagagaggggcgttcttgtgtggggtgcccgggactgggactgcggtgcgatgaggcgggggagctcccgtcggagaccgacacgtctctggggcttggaggcactgcagaacgggcggcactggggagcccgagcgtctttgtctccaaggagcagaggttgaggcggagtctcccctggaagggcagtggagccgcagagagccatagagggctgtgcagggaggacgaatgggagggtcacgcccagagttagaagtttaaagttggggaaaacaggatgttgaacgggggcagggggaccgctgaggagaccccttgagttatggtagggctg

SEQ ID NO: 426056 - DNA, 2246 bp, Homo sapiens
gtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagggctatgtgacctttgaggatgtggctgtctacttctcccaggaggaatggagattgcttgatgacgctcagaggctcctctaccgcaatgtgatgctggagaactttacacttctggcctctctgggttgttggcatggagccgaggctgaggaggctcctgagcagattgcttctgtaggactgctcagttcaaacattcagcaacaccagaagcagcactgtggagagaaacccttaaaaagacaacagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccattacagagactgaa

SEQ ID NO: 426057 - DNA, 885 bp, Homo sapiens
gccctcatggttgcgttacatgggctacctagggatctgttcactgatttagagggtcccagagctctgggtcgggactgaggtgaaagagcggaaaaacgcgagaagcggtgttccttctacacagaggctagagtgcggatcggctgagtcggctgcaggcgcccctgcctccgtcagcgtccaggtgaccgccgttcccgccccgctcttccctgggtggactggaggaggccgcgccgatgaacctgaccgaggtgcgtgcagcgtcccaggccgccccgcccaacccctcctcccagtgctgaagtcccaaggagccgccctgcaggattgtatggtctttgaggatgtggccatatatttctcccaagaggaatgggggatccttaatgatgctcagagacacctgcacagcaatgtgatgttggagaactttgcgcttttgtcatcagtaggttgttggcatggagccaaggatgaggaggtaccttccaagcagtgtgtttctgtaagagtgttacaggtcacaattccaaagccagctttgtccaccctgaaggcccagccctgcaagatgtgtagctcaattctgaaggacattctgcacctggctgagcacgatggaacacaccctgagcaagggctgtacacatgtgcagcagagcatgacctgcaccaaaaggagcagattagagagaagctcaccagaagtgatgagtggaggccttcatttgtgaaccacagtgctcacgtgggagagaggaacttcacatgcacgcagggtggcaaggattttactgccagctcagaccttctccagcaacaggtcttaaacagtgggtggaagctgtacagggatacccaggatggggaagcctttca

SEQ ID NO: 426058 - DNA, 2306 bp, Homo sapiens
gtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagggctatgtgacctttgaggatgtggctgtctacttctcccaggaggaatggagattgcttgatgacgctcagaggctcctctaccgcaatgtgatgctggagaactttacacttctggcctctctgggacttgcgtcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaacagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccattacagagactgaa

SEQ ID NO: 426059 - DNA, 890 bp, Homo sapiens
tatcagagactgtattggggttttggcaggaaaggcatgcagggtgggatgaggagcttaaaactcagtggtttgcataagtctggcagccttagggctaagagattatcccttattgtgtggtgacagggcttgtgttgattaggacaggagaaataatcatgtatgagcattagatagtggttcagcatatgggatctggatcgcaagggaaatgtaaaaacattggctgttagtttggccctccaattcttagattttaagtagataaatacagatctaaggaaacacagaataagaagttgttcatagactgaagtgtcataattttggcaggattgtatggtctttgaggatgtggccatatatttctcccaagaggaatgggggatccttaatgatgctcagagacacctgcacagcaatgtgatgttggagaactttgcgcttttgtcatcagtaggttgttggcatggagccaaggatgaggaggtaccttccaagcagtgtgtttctgtaagagtgttacaggtcacaattccaaagccagctttgtccaccctgaaggcccagccctgcaagatgtgtagctcaattctgaaggacattctgcacctggctgagcacgatggaacacaccctgagcaagggctgtacacatgtgcagcagagcatgacctgcaccaaaaggagcagattagagagaagctcaccagaagtgatgagtggaggccttcatttgtgaaccacagtgctcacgtgggagagaggaacttcacatgcacgcagggtggcaaggattttactgccagctcagaccttctccagcaacaggtcttaaacagtgggtggaagctgtacagggatacccaggatggggaagcctttca

SEQ ID NO: 426060 - DNA, 739 bp, Homo sapiens
tccatttttgatgccacacacagggtttccccttattgtgagttgtcatgtgactccctgaagccatcactgaaggctttcctacagctactgcattacctgggcagctccccagtagatactttttttttggtagggggaaagtttgagctcaaagttttaccatacagattacactcacaagatttctctctagagtgagttaacctgtgggtgattgaatgctactcccatattgatcagtttagaagttggctgggcatggtggttcatgcctgtaatcccagtacttctggaggccaagatgaaaggactgcttgaacctaggagtttgagactagtctgggcaacatggcaaaaccctccctctagtttaaaaaaaaacaaattagccagacatggtgtcatgcacctgtagtcccagctacattggaggctggggcaggagaattacttgatcccaggaagtagaggctgcagtgagctgtgatcacaccactgcgctccagactgggtgacagagtgagacattgtcttaaaaaaaaaaaaatgagggtcagctgaaggctttcctccactgatttcatggcaagttttccagatggttccaaatgtctactgttcatacctcctgtggtgttcttccacattgtatcaggattggtgtgtatgaccaatgtaacagggacatgaaaacatatctcactgaagctaggtcataaaagacattatgctttct

SEQ ID NO: 426061 - DNA, 407 bp, Homo sapiens
ccctgtctcaaaaaataaattgtataaattgttatcttacactgagttaggttcctaaaaatgtggaaaaatgacattctaatactgatggaattcaatggtttttctagtatgaatctcacttcttaaaaatggagagaatattcaaggcttttatagcataccaaactatactgtcttgtgcttggtaatatgactgtttgtgtcacaggcttttcaacactgtgtatactcaacatattcctctgttgtatgatctccgaaatgtgacttaaggaatgagtgtcccctggttttccatttttgatgccacacacagggtttccccttattgtgagttgtcatgtgactccctgaagccatcactgaaggctttcctacagctactgcattacctgggcagctcc

SEQ ID NO: 426062 - DNA, 395 bp, Homo sapiens
  misc_feature (226)..(226): n is a, c, g, or t
  misc_feature (276)..(276): n is a, c, g, or t
  misc_feature (282)..(282): n is a, c, g, or t
  misc_feature (288)..(288): n is a, c, g, or t
  misc_feature (296)..(296): n is a, c, g, or t
  misc_feature (315)..(315): n is a, c, g, or t
  misc_feature (325)..(325): n is a, c, g, or t
  misc_feature (353)..(353): n is a, c, g, or t
  misc_feature (360)..(360): n is a, c, g, or t
  misc_feature (378)..(378): n is a, c, g, or t
gttggaggtttaaggactgaggagcctgtgtgtaacggaggtggacaataggcaaggaatgaaagataactttgagatataaagcctaggtgaatgatccgtccattagcagatacgaagctgtcggaggagctggtttgggaaaacaggtagtgtcagtggctctagaaaaatattaagtaggttggaggttttaaggacttgagtttttgggaagagttagatngaggttccaaaacgttagatccaaggaattagatttttccgtacctttgnaaaatngaaacncttttccnttttgccattaaaatttgntttccacccnttggggagccagcccacctttttttggnaaatttngcccaccttcccccccgnttttttttcctgacccc

SEQ ID NO: 426063 - DNA, 5663 bp, Homo sapiens
gaattcggcacgagcacttccttctcggctagattatctgaaactgttgtcggttcttgagatgatactaccaccgaatgtctgtgtttcattgtctagtccaacctgtattgtggatatctacaacgttccggcaatagttttgcaggtgcatcacatttttgtttttgttttgggaggaaaagggagggcacggcagccaggcttcatattcctacaagtgcatgcttcaagattactgtacttacagtgtttccaacatcttctcataaaaggggaaagcttcatagcctcaaccatgaaggaaaccagtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccgctggtggacgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcggcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatctccttagtgtctgcaggtgttagtggtgtgctaaaagcaaggaaagcgagttagtcttttcagtgtcttttgcaattcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcgatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcatgtccttacactccagcctggataacagagcgagaccctgtctcaaaaaaataaaataaaaaataaaaacacccttgcctgcgctccattcccaggttataatttaattactgtgggatgagacccagacatcaatatttttctagattcttcaggtgattctaattcacagccagagttggaagccctgcgtggcctttgaaggtctagatgattcttcttccttgccctttgagcttttccccatctcacaggtatctagaaaaaaactcctcttctttggcaacctgtccttttaaaatcacactctacccacctgtacagaagaccatgccctataat

SEQ ID NO: 426064 - DNA, 1463 bp, Homo sapiens
gaaaaaatagagatgagactttttcatattcataaccctggaacaagaccagcagaggaaggtcaaggcacaacggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcgatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcatgtccttacactccagcctggataacagagcgagaccctgtctcaaaaaaataaaataaaaaataaaaacacccttgcctgcgctccattcccaggttataatttaattactgtgggatgagacccagacatcaatatttttctagattcttcaggtgattctaattcacagccagagttggaagccctgcgtggcctttgaaggtctagatgattcttcttccttgccctttgagcttttccccatctcacaggtatctagaaaaaaactcctcttctttggcaacctgtccttttaaaatcacactctacccacctgtacagaagaccatgccctataat

SEQ ID NO: 426065 - DNA, 3433 bp, Homo sapiens
gacgcacactgggtaggtttgaatttgttttgttttcaaaaattaaacaaatgatccttcagcatcatcgcctccgctgctttatcaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatctccttagtgtctgcaggtgttagtggtgtgctaaaagcaaggaaagcgagttagtcttttcagtgtcttttgcaattcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcgatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcatgtccttacactccagcctggataacagagcgagaccctgtctcaaaaaaataaaataaaaaataaaaacacccttgcctgcgctccattcccaggttataatttaattactgtgggatgagacccagacatcaatatttttctagattcttcaggtgattctaattcacagccagagttggaagccctgcgtggcctttgaaggtctagatgattcttcttccttgccctttgagcttttccccatctcacaggtatctagaaaaaaactcctcttctttggcaacctgtccttttaaaatcacactctacccacctgtacagaagaccatgccctataat

SEQ ID NO: 426066 - DNA, 698 bp, Homo sapiens
ttagttgcataacttaaaaatatgaggaaattttggaatatatctctaaaaccacggaattgtcactgaaatatatatttcttgagacagtgggcaaagttcccatttatgggaaatactttccttttttcacacacatgaaactgagaaaaattatatcaaatgagaaatatttttctctaaaataatcttaagtaccccaataatgcaatactggggaaatgtaaattttcaaaactcagatttgaaacaggttattattaaacaaatatacataaatcttattgtttggcaagatttttcaaaaattagagaactagttaaaccaccatactgtccttaaatcatatttcaaacttacatacctagtgcttttatgttctgaatgtagagtcttcaatttaatgacaatctagactgaatgctgtaatatacaagcaagtcacagttcacttcaaaccaaaagaaataatcagtcttctgtttttatcaaaatcatgatattaagataactatacaatttatctgtgaccagtgatggacccagagagtgttgtgttatggcattctgtggaaagtctttgttccttctttacttttggcttcttcttctgaaacatcttctttatccgcctcttgttcttcctccagttttttcaaaggttgagcagattctgataatttttttgaagggtatg

SEQ ID NO: 426067 - DNA, 330 bp, Homo sapiens
gtgtggattctgtcttcaacttgcttccaaaaactgaggtgtttggccaggcacagaggctcctcccctctcactattcagcacacacctgctcacagtttactacaaaccaagcacctagccagactatttcccaaaatcactgctctcattcaatggcctgctaagctaagttccttaccacaatcttcccacataaaggtgacctctgctttgggggatacagaatttaagcatcacaaaaatctgtatgggataagaaaagcacgttggctaaaagatagctaatgaggactctagtcctaactctgctatcaaactacatatgca

SEQ ID NO: 426068 - DNA, 658 bp, Homo sapiens
tgaaaagaattaacccggcaagtcccgtcccactcccccagctcagaggtcctttttactagagctgccctagagagttagctggagatgtagagtcaccccatcaggtgctgtgccggccgctcggctgtgtctcctgcgtgtcttaacgtcccttgtgtccggatttccatttcagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426069 - DNA, 1601 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426070 - DNA, 2095 bp, Homo sapiens
  misc_feature (1618)..(1618): n is a, c, g, or t
  misc_feature (2095)..(2095): n is a, c, g, or t
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttcttaaaaaaaaaaaacacanaaaaaaatctggggacataaataaagggggcggaaacaagggcactggacatggcccatgggtcaaagacggataccgagaccaaatttcttggcaccaagggggaaaacacaggagaacccataaagggaagccaaaaaattcggaagaccaggtaactgtgaaaagacaaaacacaaaggcgaaacagacgaacagacagcaagaacggggggggagacaaccgcgcccagagagggaggaagcaaagaggaaaacagacagaggacgagacgaccccgccgcacaacagacaaaagagagagagagaatagaggacaaaagcagagaggaaaagcaagaaaagcaggcgagagacgaggagcggagcggggaagaacaagacgagacaaagaacagagcgaaagaacgagcagaggaggagccgggccagaagacgaggagggagagaagagcgacaggagcaggagcgtggan

SEQ ID NO: 426071 - DNA, 667 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccatccccatccacctgtacggacatcttttccgttgcggtttgagaatgttcctataataaacccctctgctttgttctttcttctcgtctctcttttcttgggc

SEQ ID NO: 426072 - DNA, 419 bp, Homo sapiens
  misc_feature (263)..(263): n is a, c, g, or t
  misc_feature (265)..(265): n is a, c, g, or t
  misc_feature (272)..(272): n is a, c, g, or t
  misc_feature (274)..(274): n is a, c, g, or t
  misc_feature (280)..(282): n is a, c, g, or t
  misc_feature (288)..(288): n is a, c, g, or t
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctntntgaaaantntatcannnaatttnaacacagagggagtaccctgtgccccgcgggagatcactcttaacggggagagagaaatgtctcttctcatagtggcgctccctcttctcgagaagactctcgagagaggaaaagagggtgatgcgcagtt

SEQ ID NO: 426073 - DNA, 376 bp, Homo sapiens
ctgatgggagccaggccacagggaggaggcttctttgtgggtctctcctgcagagggtgggggtctcagggtcttaggtgatactggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatccttctgtgtactccgaggtggatctccatccccatccacctgtacggacatcttttccgttgcggtttgagaatgttcctataataaacccctctgctttgttctt

SEQ ID NO: 426074 - DNA, 279 bp, Homo sapiens
agttcgacggagactctccaaagtaaaacttcttctcggcgagggagtttttaactttggaggactcctcatgcaccctgtgctggagtccctgaggaatactgaccggcagtggctgattgacaccctctatgccttcaacagtggcaacgtagagcggttccagactctgaagactgcctggggccagcagtgaaggctctctcctgctgctcagacactggtagatccttgatgtcaacacagcaggagagagtctccgtcgaactgggtaccgag

SEQ ID NO: 426075 - DNA, 1862 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttcttgttaaaaacaacaagcatatatggtgcagggggggggcgctgaaagatgtcgtggggggggcaagatttcggttacccggctttgttggacgaggtggcctatagggggctgatataagacaggccgtgcgcgtttacacggcgagggaaaaggtcggggggatttggggagagaacaattggggggtgacagttggacactacgattaggccagggaaaaacttgggtagggtaacagctttgggaatggcgggcttcat

SEQ ID NO: 426076 - DNA, 1626 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctttcttctcgtctctcttttcttgggc

SEQ ID NO: 426077 - DNA, 1703 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgtaaagtgaggtgtacttagggccataggagcttctgcatagacttgaacgttcagtcgtaaggccccctggagcctgtgtattcccaggtggaactaatctccattgaccggtacggacatattatccgttgcgggtctagaaggtgctaatatttaccactgcggtttgcttaacatctacttacttacaaatctccagggtatgactcgatcctcatacccctttgtgccagtctatttacctttacttgacctcatgttagcataagtacattgag

SEQ ID NO: 426078 - DNA, 1435 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatccttctgtgtactccgaggtggatctccatccccatccacctgtacggacatcttttccgttgcggtttgagaatgttcctataataaacccctctgctttgttctt

SEQ ID NO: 426079 - DNA, 1403 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426080 - DNA, 1474 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatctacacggccctgttccgtcggttctgatactgagagaggttgcagcagagtgctgtagacgtacatgattggtggggtgggatcctgttgagacagctgtctgcttaacagacggtctatgagcagccaagagagctctgtgtttctgaagtgagttagtcaggtacgagacgagaacgtcagaagcctatcgatcaggtcctcaatccgcatctccgttagataacttcagcaagggttcatatagaagccttgtcttggtggtc

SEQ ID NO: 426081 - DNA, 1566 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426082 - DNA, 1686 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacaggtaaaagcctctcatccgtttttcactttggagatgagtacattgatgctcggtggtgctcaaagactggtggcttttatttcagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426083 - DNA, 1625 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatttccacgagggacagaggattcatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426084 - DNA, 1013 bp, Homo sapiens
agttcgacggagactctcctgatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426085 - DNA, 963 bp, Homo sapiens
  misc_feature (900)..(900): n is a, c, g, or t
  misc_feature (904)..(904): n is a, c, g, or t
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgaattagcagctaatgaagccaagcttctgaggaaantcangtgatgctcatgggttacttcacacaccccgcccatccagaccccctttgggaatgcca

SEQ ID NO: 426086 - DNA, 1323 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcaggtaggactcccacgatgcccagcccttattcccccatgtgtctactcgctcatacaacagatgttcattgagcgtcttccctaggcacacaggaaagaacagggcaaagaggagaccaagataggctagtccttgctctcatagagcagagagttaagtggttggttagctacagcattactcagtgctgcagacaaagagtgagggtgttctgagaaaacagaatcgaatgtgggccctgcatctacgctgggtggagggggtgtcacagaagatgtagaagtcatagtgacctaaggtctgtgtgaccttaggaatgagtgaagaggtacgggaagagtgcactcagcggagaaaacggaaaagtttagtatctttgctgaactgaaagagggatgtgtgaggctaacatgagtgggtgggagagagcatgggatgaaggaggaacaaatgcctggtgaag

SEQ ID NO: 426087 - DNA, 1109 bp, Homo sapiens
tactttttgttatatgagatttttaaagctaaacaggactgattattatgactggattgtaagtgggcctgtgttgctaccatagttgtctgagcagcaggagagagccttcacgctggggctagcaggacttctcggcgagggagtttttaactttggagaactcgtaagttgaccctgagctcagcttccttaacgagagagactaaagtgttactagctgaccatctccatcctcacagctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426088 - DNA, 878 bp, Homo sapiens
ccccgtgatgcagttgttgcctcattgcatgtcgcttcttgtgtacacgcacatctgtctttccccactagaacttaagcttcgtcaggaagtggcccttagatttctggtttgccgtggtcacccctggtcaaccctggcaaattgtggcctcaagtacttgttcggggattgaacaatggctactgtcagaaactcctatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426089 - DNA, 1083 bp, Homo sapiens
ccccgtgatgcagttgttgcctcattgcatgtcgcttcttgtgtacacgcacatctgtctttccccactagaacttaagcttcgtcaggaagtggcccttagatttctggtttgccgtggtcacccctggtcaaccctggcaaattgtggcctcaagtacttgttcggggattgaacaatggctactgtcagaaactcctgtaaggcattttgctgttatccttcttatctaagcattaaaagcttgttcttaacaagatatatgtctaatattaggaaactttttagtatgtggggtactaataagatctctattttcagagccaatattgacaaaacatccttatcagttctctatttttatttggaaaaatagtttaaaatagttaataaaattttttccagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426090 - DNA, 1276 bp, Homo sapiens
ccccgtgatgcagttgttgcctcattgcatgtcgcttcttgtgtacacgcacatctgtctttccccactagaacttaagcttcgtcaggaagtggcccttagatttctggtttgccgtggtcacccctggtcaaccctggcaaattgtggcctcaagtacttgttcggggattgaacaatggctactgtcagaaactcctgtaaggcattttgctgttatccttcttatctaagcattaaaagcttgttcttaacaagatatatgtctaatattaggaaactttttagtatgtggggtactaataagatctctattttcagagccaatattgacaaaacatccttatcagttctctatttttatttggaaaaatagtttaaaatagttaataaaattttttccagatgactttcacacgacctgccaatcacagacaactcacttttgaagaaattgccaaaagtgctaaaatcacagtgaatgaggtacggtccctaggctcagggtgttagagcagcaaagctgccacatggaggagtcaaggctcttgtgtgagcgctgtgctccctagacagtaaaaaatgacgggaggagcggcatctgcttctcacaagccatctgggtccatgggggtgtgtcaggctatcttgtcttacacacgcctccctctctgcacaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426091 - DNA, 1399 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcgtaagttgaccctgagctcagcttccttaacgagagagactaaagtgttactagctgaccatctccatcctcacagctcatgcaccctgtgctggagtccctgaggaatactgaccggcagtggctgattgacaccctctatgccttcaacagtggcaacgtagagcggttccagactctgaagactgcctggggccagcaggtaggactcccacgatgcccagcccttattcccccatgtgtctactcgctcatacaacagatgttcattgagcgtcttccctaggcacacaggaaagaacagggcaaagaggagaccaagataggctagtccttgctctcatagagcagagagttaagtggttggttagctacagcattactcagtgctgcagacaaagagtgagggtgttctgagaaaacagaatcgaatgtgggccctgcatctacgctgggtggagggggtgtcacagaagatgtagaagtcatagtgacctaaggtctgtgtgaccttaggaatgagtgaagaggtacgggaagagtgcactcagcggagaaaacggaaaagtttagtatctttgctgaactgaaagagggatgtgtgaggctaacatgagtgggtgggagagagcatgggatgaaggaggaacaaatgcctggtgaag

SEQ ID NO: 426092 - DNA, 506 bp, Homo sapiens
  misc_feature (470)..(470): n is a, c, g, or t
  misc_feature (488)..(488): n is a, c, g, or t
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaataacatcgggcctcagtncaaggaacattgagtgtnaagaatctcacacctcct

SEQ ID NO: 426093 - DNA, 1476 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagtgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426094 - DNA, 1429 bp, Homo sapiens
gtggagatgggcgtcactactgctaccctcatttcacctgcgctgtggacactgagaacatccgccgtgtgttcaacgactgccgtggcatcgataaacaccgaaaagtaagagccacattaggatcagtcatctgtctaactacgtgaagaatgatttccacgagggacagaggattcatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426095 - DNA, 1547 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426096 - DNA, 1677 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcgtaagttgaccctgagctcagcttccttaacgagagagactaaagtgttactagctgaccatctccatcctcacagctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426097 - DNA, 1280 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagaattcccagtgaatgaaggtgaagccttctggttgaataaaggccctttacggtgggcgcttggtaaaaggccagtatagcgaagtgggcaaacgagtcccacatgaccctggggtgcaagccccaagtgttggaatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 426098 - DNA, 845 bp, Homo sapiens
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggggtgggtggttggacctctttcttacgtggccgtagggtcccactggatgcgggcccgccgttatgata

SEQ ID NO: 426099 - DNA, 964 bp, Homo sapiens
  misc_feature (941)..(941): n is a, c, g, or t
  misc_feature (947)..(947): n is a, c, g, or t
cgccggaagtgggagcatttccggcagccatccccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaatcctctgtccctcgtggaaatcattcttcacgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagggtaacctaggccattaaatccatgtcacacaggagcatattctccaaacttagcatctgtgagttgcttgaggtgacagttctcagaaattactaaggtggggctgggcacggtggctcacgcctgtaatcccagcactttggaaggctgaagtgagtggatccacctgaggtcaggagttcgagaccagcctggccaacatggtgaaaccctgtctctactaaaaatacaaaaaactagccacgtgtgtgttttcaatccttgggagggtgccatccacattttnacagtncctgtgcctgagaattt

SEQ ID NO: 426100 - DNA, 399 bp, Homo sapiens
aaatatagaggactgtccgaggagctcgggagggagccaggagtgaggcaagcagcattccctgacatttctgcctaagcaagggctctgcaggccaggaggagactgtcacccacaacggaatgtccttctttggaagcagctgaggacctggaaaacccagcagttcctctttccagcgttggccaaggacatgagaaagacccctcagtctgccaagctggagaatagctccctctgtgacattgaagcaagaagaaaaggcatggagagatttggctactttgtttgttcttctaaaggaacacctggttttacccgtcaactgaaatggccgtgtgtggtacattaagttcagtaagaatatacactttcagctatctgctaacagaatcaagg

SEQ ID NO: 426101 - DNA, 1277 bp, Homo sapiens
ctctgtctacctctgggcgggactgccgggtgatgagatactcggtcggcgacggtagaacgggcgacggcgacaaccgcaatcacatccacgacggtgatcatggcagagaatcacgcccagaataaagccaagctcatctctgagacccggaggaggttcgaagctgagtatgtgacagataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatggtaagctgttcaatttaaccttgactgtaatatatactgtataaatggtattgttttacatttatctaatcatgtatttgcacatattcctagcagtcatcataaacaccagaatataattatttataaagacccagtaatattttcaaaggaacagcttataagtcttttaagtgggatcattcataaggaaatcagatcaccagagagcagaatcacactcagattcttcattcacagcagagtttcctaatctgtgtttaattcagtaccattaagcaatagcaagacagtatctttgctactaggcctagaaataaggagatactgtccatttttctcagttgttgcctatgcctttctctgtccccacagttccttgtgctaataggttaataggtacgccatatagaattgttaaatgaatgagagtcaccccaaaaatgcaagcttatccccaaggaagcctatcacagtcttctctgtatattgtttttatttttgtgggtacatagtagatgtacatattttggggtacatgcagccttaacttcttaatttctaagtctgctactagatagaatttttttccaaaaatgagagtttcaagtcttggagttttataatggtcttcaagtatatgaagacctgttagttctctccaccaaaaaattgaacaagaagaaactggcataacttctgttttcagttaggcataaagcagaattttctgtccttgaggattataacctctgaagtgacttcaatctgaagacttaacacaaaatagtcaacaataaatccagagcagatactctcctcactcttcatgcttgcagaaggaatccctgaaagggggattagtaaaaaataatgtgattggaaatttaacaaatgtaggtaatttcaacagtgaagcatttattaaccaaagaaagaa

SEQ ID NO: 426102 - DNA, 4572 bp, Homo sapiens
ctctgtctacctctgggcgggactgccgggtgatgagatactcggtcggcgacggtagaacgggcgacggcgacaaccgcaatcacatccacgacggtgatcatggcagagaatcacgcccagaataaagccaagctcatctctgagacccggaggaggttcgaagctgagtatgtgacagataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatgaccttaatgaatcctccattcccagatggttattggaaattggtgttatttatctccatggttatgacaaagaaggtaacaaattgttctggatcagggtgaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgacatggactttgtacgctttatcatcaactgctttaaggtttattaccctaaatacctctcaaaaatagtgatctttgatatgccttggttaatgaatgctgctttcaaaattgtgaaaacctggcttggtccagaagcagtgagcttgttgaagtttacaagcaaaaatgaagtccaggactatgtcagtgtagaatacctgcctccccacatgggtggaactgatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaagattaacccaaccgaatctacttccaaagcagaagaaaatgaaaaagttgattcaaaagtgaaagctttcaagaaaccattgagtgtatttaaaggccccttactacacatcagcccagcagaagaactgtactttggaagtacagaatccggagagaagaaaaccttaatagtgttgacaaatgtaactaaaaatatagtggcatttaaggtgagaacaacagctccagaaaaatacagagtcaagccaagcaatagcagctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacactggtgtgctactttgtcttaatttgggcttttctgtttcagtttgccacctccagctgtgaaatggactgcagtccaccctaagtactgtgcacagtatctccctgtgtgtgtgcacagtggcttccccttacatggtagatttttggccttaatataatctaatcccaaagtagttgtgtatgttttctgttccttggcaaataaatgaagaaataattagccaagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaacgtttgtacttgtcttgattaatcatatatttacacttgatttttttctgtcttcatttgtttttatttaatcataattgcatgatttttttggtactctaatcagtaattttatttttaatcatgtcattacctattcatgaccaaattaccaaggaaccaacatttagatttagatatttgttttcacttaggaatggaaattaatagattttccatgaaagcattagtgaaatatcattaccttgatctgcaagtagcctaaaaatgcgattgctggtaaacctggcctcaaatttcatactaccataactgtttttatatattgccactaattttgactggatttaatagcactttattgtacaactacaaaaaaaaatatattcctagaattgttgccagtgtaatttctctaatgttctggtgcttttcatatattttcagtatttttattactatattggtattttctttgtataaattgattgattaaaagaacatgttttctattttaatatgttttagaaaaataattacatttatgaaataaatatcatcaggaaaaaaaaaaaaaaaaaactcgagttttttttttttttttttgatagttttaaagctgtggaaaagctttattatagattttagtccagaattaaaaaagttcaaacaataattgtttggaaccccaaataattaaaaggaaacacagcattcccataaacaagcattctggcatctgttagaaattttccctcaaattatgaaaagtacctctcccatgctttcccaaggattgttataatacccacaaatatttggggatttaaggggatactttatccaaaagttttctttttaaggcatgaccctgattaattttttttcaatatctaaccatttcaagaactaccttaaataaaatggaactatttcattaatttgccacttgatcccattaagagg

SEQ ID NO: 426103 - DNA, 4217 bp, Homo sapiens
ggtaatactctagtcagaagcctcaatttgtcatgcacagataaggtatgtcacagaacacaggccttgtctaggtttctcatgggcttcaggtgttgagaaagaaggtggaatcagtctgaaactcaccccaaatcactgtagtgacatgacccttttgacagtcatgatatattttttggtaaaatttttttgaaaaagccattgattgataaactgtcttgaccaactttaaaattactgtaaattgaatgttattttcagaatgtacattctcatttgtgtttgcaaaagtcagttgttacatagaaagcaatagagaaaatcaacaaatccaaaatttggttctttggaaaatgcaacacaattgacaaacctttagctaataaagaagaaaaggaaagactcaaagtattttagtaggctcatgtgaaattattttcttgtaggatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaagattaacccaaccgaatctacttccaaagcagaagaaaatgaaaaagttgattcaaaagtgaaagctttcaagaaaccattgagtgtatttaaaggccccttactacacatcagcccagcagaagaactgtactttggaagtacagaatccggagagaagaaaaccttaatagtgttgacaaatgtaactaaaaatatagtggcatttaaggtgagaacaacagctccagaaaaatacagagtcaagccaagcaatagcagctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacactggtgtgctactttgtcttaatttgggcttttctgtttcagtttgccacctccagctgtgaaatggactgcagtccaccctaagtactgtgcacagtatctccctgtgtgtgtgcacagtggcttccccttacatggtagatttttggccttaatataatctaatcccaaagtagttgtgtatgttttctgttccttggcaaataaatgaagaaataattagccaagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaacgtttgtacttgtcttgattaatcatatatttacacttgatttttttctgtcttcatttgtttttatttaatcataattgcatgatttttttggtactctaatcagtaattttatttttaatcatgtcattacctattcatgaccaaattaccaaggaaccaacatttagatttagatatttgttttcacttaggaatggaaattaatagattttccatgaaagcattagtgaaatatcattaccttgatctgcaagtagcctaaaaatgcgattgctggtaaacctggcctcaaatttcatactaccataactgtttttatatattgccactaattttgactggatttaatagcactttattgtacaactacaaaaaaaaatatattcctagaattgttgccagtgtaatttctctaatgttctggtgcttttcatatattttcagtatttttattactatattggtattttctttgtataaattgattgattaaaagaacatgttttctattttaatatgttttagaaaaataattacatttatgaaataaatatcatcaggaaaaaaaaaaaaaaaaaactcgagttttttttttttttttttgatagttttaaagctgtggaaaagctttattatagattttagtccagaattaaaaaagttcaaacaataattgtttggaaccccaaataattaaaaggaaacacagcattcccataaacaagcattctggcatctgttagaaattttccctcaaattatgaaaagtacctctcccatgctttcccaaggattgttataatacccacaaatatttggggatttaaggggatactttatccaaaagttttctttttaaggcatgaccctgattaattttttttcaatatctaaccatttcaagaactaccttaaataaaatggaactatttcattaatttgccacttgatcccattaagagg

SEQ ID NO: 426104 - DNA, 3871 bp, Homo sapiens
ttttatttgtctaaaagtaattaatttaaaactttgatttagttcctttctctaatttttaaaagagcacttagtagttgtcactttttacaagtaatcaggaacttgatagatggataaatacaatgttataatttagaaaaatttaaagactcttaagggaaggaccatattgtattttctagagtaacctatgttatgtataatagtaggcactaaaatagatgttaatggtcatgttaatatatgctaaatagttatcctttttttttgtctttagattaacccaaccgaatctacttccaaagcagaagaaaatgaaaaagttgattcaaaagtgaaagctttcaagaaaccattgagtgtatttaaaggccccttactacacatcagcccagcagaagaactgtactttggaagtacagaatccggagagaagaaaaccttaatagtgttgacaaatgtaactaaaaatatagtggcatttaaggtgagaacaacagctccagaaaaatacagagtcaagccaagcaatagcagctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacactggtgtgctactttgtcttaatttgggcttttctgtttcagtttgccacctccagctgtgaaatggactgcagtccaccctaagtactgtgcacagtatctccctgtgtgtgtgcacagtggcttccccttacatggtagatttttggccttaatataatctaatcccaaagtagttgtgtatgttttctgttccttggcaaataaatgaagaaataattagccaagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaacgtttgtacttgtcttgattaatcatatatttacacttgatttttttctgtcttcatttgtttttatttaatcataattgcatgatttttttggtactctaatcagtaattttatttttaatcatgtcattacctattcatgaccaaattaccaaggaaccaacatttagatttagatatttgttttcacttaggaatggaaattaatagattttccatgaaagcattagtgaaatatcattaccttgatctgcaagtagcctaaaaatgcgattgctggtaaacctggcctcaaatttcatactaccataactgtttttatatattgccactaattttgactggatttaatagcactttattgtacaactacaaaaaaaaatatattcctagaattgttgccagtgtaatttctctaatgttctggtgcttttcatatattttcagtatttttattactatattggtattttctttgtataaattgattgattaaaagaacatgttttctattttaatatgttttagaaaaataattacatttatgaaataaatatcatcaggaaaaaaaaaaaaaaaaaactcgagttttttttttttttttttgatagttttaaagctgtggaaaagctttattatagattttagtccagaattaaaaaagttcaaacaataattgtttggaaccccaaataattaaaaggaaacacagcattcccataaacaagcattctggcatctgttagaaattttccctcaaattatgaaaagtacctctcccatgctttcccaaggattgttataatacccacaaatatttggggatttaaggggatactttatccaaaagttttctttttaaggcatgaccctgattaattttttttcaatatctaaccatttcaagaactaccttaaataaaatggaactatttcattaatttgccacttgatcccattaagagg

SEQ ID NO: 426105 - DNA, 3301 bp, Homo sapiens
aactgtcttaggtgaacctggggaagaggaatgaggacttttacctctgttacatagacttctgtgtataactgttttcattttatattttacttttataagaaaattaactttttaagaagttatgttttctttggattttaataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacactggtgtgctactttgtcttaatttgggcttttctgtttcagtttgccacctccagctgtgaaatggactgcagtccaccctaagtactgtgcacagtatctccctgtgtgtgtgcacagtggcttccccttacatggtagatttttggccttaatataatctaatcccaaagtagttgtgtatgttttctgttccttggcaaataaatgaagaaataattagccaagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaacgtttgtacttgtcttgattaatcatatatttacacttgatttttttctgtcttcatttgtttttatttaatcataattgcatgatttttttggtactctaatcagtaattttatttttaatcatgtcattacctattcatgaccaaattaccaaggaaccaacatttagatttagatatttgttttcacttaggaatggaaattaatagattttccatgaaagcattagtgaaatatcattaccttgatctgcaagtagcctaaaaatgcgattgctggtaaacctggcctcaaatttcatactaccataactgtttttatatattgccactaattttgactggatttaatagcactttattgtacaactacaaaaaaaaatatattcctagaattgttgccagtgtaatttctctaatgttctggtgcttttcatatattttcagtatttttattactatattggtattttctttgtataaattgattgattaaaagaacatgttttctattttaatatgttttagaaaaataattacatttatgaaataaatatcatcaggaaaaaaaaaaaaaaaaaactcgagttttttttttttttttttgatagttttaaagctgtggaaaagctttattatagattttagtccagaattaaaaaagttcaaacaataattgtttggaaccccaaataattaaaaggaaacacagcattcccataaacaagcattctggcatctgttagaaattttccctcaaattatgaaaagtacctctcccatgctttcccaaggattgttataatacccacaaatatttggggatttaaggggatactttatccaaaagttttctttttaaggcatgaccctgattaattttttttcaatatctaaccatttcaagaactaccttaaataaaatggaactatttcattaatttgccacttgatcccattaagagg

SEQ ID NO: 426106 - DNA, 3543 bp, Homo sapiens
ctctgtctacctctgggcgggactgccgggtgatgagatactcggtcggcgacggtagaacgggcgacggcgacaaccgcaatcacatccacgacggtgatcatggcagagaatcacgcccagaataaagccaagctcatctctgagacccggaggaggttcgaagctgagtatgtgacagataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatgaccttaatgaatcctccattcccagatggttattggaaattggtgttatttatctccatggttatgacaaagaaggtaacaaattgttctggatcagggtgaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgacatggactttgtacgctttatcatcaactgctttaaggtttattaccctaaatacctctcaaaaatagtgatctttgatatgccttggttaatgaatgctgctttcaaaattgtgaaaacctggcttggtccagaagcagtgagcttgttgaagtttacaagcaaaaatgaagtccaggactatgtcagtgtagaatacctgcctccccacatgggtggaactgatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaagattaacccaaccgaatctacttccaaagcagaagaaaatgaaaaagttgattcaaaagtgaaagctttcaagaaaccattgagtgtatttaaaggccccttactacacatcagcccagcagaagaactgtactttggaagtacagaatccggagagaagaaaaccttaatagtgttgacaaatgtaactaaaaatatagtggcatttaaggtgagaacaacagctccagaaaaatacagagtcaagccaagcaatagcagctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacacaaaaaaaaaaaaaaaagaaaaaaaaaaaaaaaatagaagggaaaccaaagaacccaaaaagaactaaaaaaaagaatattggcagtgcactggtcaccccttatacaacgtagagggatagaaacattaattgcccagtgtttccaaaacgggcgttcggaaaaaccctggttgacccaaatttaatcaccttggagacaatcccctttttcgcaagttggaatataggaaaagggcctggacagactgccttttcataaaataatagccctcagaatggcaaaatgcaaatttaacgcgtaaaattttgggaaaaatggccggaaaaatttttgttacaacaatatgtttaccg

SEQ ID NO: 426107 - DNA, 4518 bp, Homo sapiens
ctctgtctacctctgggcgggactgccgggtgatgagatactcggtcggcgacggtagaacgggcgacggcgacaaccgcaatcacatccacgacggtgatcatggcagagaatcacgcccagaataaagccaagctcatctctgagacccggaggaggttcgaagctgagtatgtgacagataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatgaccttaatgaatcctccattcccagatggttattggaaattggtgttatttatctccatggttatgacaaagaaggtaacaaattgttctggatcagggtgaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgacatggactttgtacgctttatcatcaactgctttaaggtttattaccctaaatacctctcaaaaatagtgatctttgatatgccttggttaatgaatgctgctttcaaaattgtgaaaacctggcttggtccagaagcagtgagcttgttgaagtttacaagcaaaaatgaagtccaggactatgtcagtgtagaatacctgcctccccacatgggtggaactgatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaagattaacccaaccgaatctacttccaaagcagaagaaaatgaaaaagttgattcaaaagtgaaagctttcaagaaaccattgagtgtatttaaaggccccttactacacatcagcccagcagaagaactgtactttggaagtacagaatccggagagaagaaaaccttaatagtgttgacaaatgtaactaaaaatatagtggcatttaaggtgagaacaacagctccagaaaaatacagagtcaagccaagcaatagcagctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacactggtgtgctactttgtcttaatttgggcttttctgtttcagtttgccacctccagctgtgaaatggactgcagtccaccctaagtactgtgcacagtatctccctgtgtgtgtgcacagtggcttccccttacatggtagatttttggccttaatataatctaatcccaaagtagttgtgtatgttttctgttccttggcaaataaatgaagaaataattagccaagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaacgtttgtacttgtcttgattaatcatatatttacacttgatttttttctgtcttcatttgtttttatttaatcataattgcatgatttttttggtactctaatcagtaattttatttttaatcatgtcattacctattcatgaccaaattaccaaggaaccaacatttagatttagatatttgttttcacttaggaatggaaattaatagattttccatgaaagcattagtgaaatatcattaccttgatctgcaagtagcctaaaaatgcgattgctggtaaacctggcctcaaatttcatactaccataactgtttttatatattgccactaattttgactggatttaatagcactttattgtacaactacaaaaaaaaatatattcctagaattgttgccagtgtaatttctctaatgttctggtgcttttcatatattttcagtatttttattactatattggtattttctttgtataaattgattgattaaaagaacatgttttctattttaatatgttttagaaaaataattacatttatgaaataaatatcatcaggaaaaaaaaaaaaaaaaaactcgagttttttttttttttttttgatagttttaaagctgtggaaaagctttattatagattttagtccagaattaaaaaagttcaaacaataattgtttggaaccccaaataattaaaaggaaacacagcattcccataaacaagcattctggcatctgttagaaattttccctcaaattatgaaaagtacctctcccatgctttcccaaggattgttataatacccacaaatatttggggatttaaggggatactttatccaaaagttttctttttaaggcatgaccctgattaattttttttcaatatctaaccatttcaagaactaccttaaataaaatggaactatttcattaatttgccacttgatcccattaagagg

SEQ ID NO: 426108 - DNA, 330 bp, Homo sapiens
cagagtcaagccaagcaatagcagctgtgacccgggtgcatcagtggatatagttgtgtctccccatgggggtgagttgtcacttagtagccacagcaggtgttgggtgtggtgggggtaaggggacctggaccttggctctgagtcagcagagatgtcaggctagaatctagaaattagcagagtatcacgagtcacctcacctcgctgtagacatcttttttcccacatgtgaaatggggtggtcaaagaggtctctaaagccctttccagcattaaaatgtattgtttctaacaagtaaaattgtttaaactgacaccaattgaaat

SEQ ID NO: 426109 - DNA, 3188 bp, Homo sapiens
ctctgtctacctctgggcgggactgccgggtgatgagatactcggtcggcgacggtagaacgggcgacggcgacaaccgcaatcacatccacgacggtgatcatggcagagaatcacgcccagaataaagccaagctcatctctgagacccggaggaggttcgaagctgagtatgtgacagataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatgaccttaatgaatcctccattcccagatggttattggaaattggtgttatttatctccatggttatgacaaagaaggtaacaaattgttctggatcagggtgaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgacatggactttgtacgctttatcatcaactgctttaaggtttattaccctaaatacctctcaaaaatagtgatctttgatatgccttggttaatgaatgctgctttcaaaattgtgaaaacctggcttggtccagaagcagtgagcttgttgaagtttacaagcaaaaatgaagtccaggactatgtcagtgtagaatacctgcctccccacatgggtggaactgatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaagattaacccaaccgaatctacttccaaagcagaagaaaatgaaaaagttgattcaaaagtgaaagctttcaagaaaccattgagtgtatttaaaggccccttactacacatcagcccagcagaagaactgtactttggaagtacagaatccggagagaagaaaaccttaatagtgttgacaaatgtaactaaaaatatagtggcatttaaggtgagaacaacagctccagaaaaatacagagtcaagccaagcaatagcagctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacac

SEQ ID NO: 426110 - DNA, 748 bp, Homo sapiens
ctctgtctacctctgggcgggactgccgggtgatgagatactcggtcggcgacggtagaacgggcgacggcgacaaccgcaatcacatccacgacggtgatcatggcagagaatcacgcccagaataaagccaagctcatctctgagacccggaggaggttcgaagctgagtatgtgacagataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatgaccttaatgaatcctccattcccagatggttattggaaattggtgttatttatctccatggttatgacaaagaaggtaacaaattgttctggatcagggtgaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgacatggactttgtacgctttatcatcaactgctttaaggtttattaccctaaatacctctctcctatagtgatctctgatatgccttgagattaatgaatcctgctttcaacacttgtgctcacctgacttcgtcccgcagcataaccttttcccaattaacaacacc

SEQ ID NO: 426111 - DNA, 3773 bp, Homo sapiens
  misc_feature (825)..(825): n is a, c, g, or t
  misc_feature (956)..(956): n is a, c, g, or t
tttttcaatctgttcccagtttctaaacaattttaaatatttatgagaagcaaaccctatgtgtagggcatctgttggagtgggatgcttttagacatatattaagtatgtacatgtttaatatgtatatttaaaatgcatatatattttattatatctatattatcctatatagatatatgtaacttagctttattgttagctccataagctgccagtgttgcttttctgttggtagagctctcccatttggtgacatggaaaatacctttccattatcacaacaaagcagttgctcagtagaaagtctagatttctgtcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagctcatgcctgtaatcccagcacgttgggaggccgaggcgggtggatcacctgaagtcangagttcgagaccatcctggctaacactgtgaaaccccgtctctactaaaaatacaaaaaattagcggggcatggtggcacgcgcctgtagtcccagctactcaggaggctgaggcaggagaattacttgancccgggaggcggaggttgcagtaagcagagattgtgccactggactccagcctgggtgacagagcgagactccgtctcaaacaaacaaacaaaaaactgttttcatttgctctcttgaccaaaggataggactttagttctttaagcattattttaaacactatattgatacaaaaatatcttgcttactctaaactttagagtctaaatgaagctttttctcagtacaagattctgagtatcataaaatggttatttaattgaaacgtagtgtggtatactcttgatggttagaactcttacagccttatttatttttaagtttgttacagccaaagggttggagtgtgccagtgcacaggtagactaaggaaaacattatagaggagtgaagagaacagaccattgaaaagactattatctgaccagcggaggcagaaaagagaggaacccagttgaataggatccaatccctggttagcctctacacaataatagggagacaaggattaggagccatacctcccagagcaaggtatctttctagagcaaatttctctttctagaaggggagggtcacagggtcacagattcaccaaagctgaaagggctgaggagctcatggtagcctgggttgacctactctggagcacggtgtcttccttctaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaatttacatatggtaaatgatgaactttaaaaatgtgtccaggtgttagatgagttcattagactcttttaatgctaatggctagtacgtttaaacaaaacagcagttctctgctgcaatattcccattgaccacttaaatgaccataagtggtcatttaagaacatgttagggttagccctgatctgaatataaaagtgagaaaagggctacagtgcatttcttggtaacttaaactgagtcttgaagttataatgatccattcgagttctgtgatccttattgttcttaattgtgtttctctacgtattgttacagatgagccatacgtttctttgtatcaatgtagacatgacttcagatacctctgaggacctacccagcagtctaggaccctgggccaagtgctgggactatggtactaaatccagtagatgggctgtgtagcaactctcccagggaacacactagggtacttagggaggtgctttgtggagcatgttgaagctttgagatctgagcaggaggcagtgatgtccctggtctattcagggaaagatttcagtgtgaaatggtaaacatccaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagtttttttaattaaaaaaatagaaagctgttaggctcctaattcgtggggttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtggggagatttatttttataaggtaatttttatcctgataaggacttaaaaaaaagttttgcaactgaaattttaaagtaaacatgttaagtacagttaaaaagtaagcattgtagtaaatagtggattctctggtgtgtattttttatctcagtgttgaaaattggaaaagaatggactgaagtctaaaaactggaataatgaaggacactaaatgcctttattgtagatactatgtttgtaagtctatagctaagcaacttaagccaaaaaggtctttcaactgaagctttaatcaacttattttggagatgttctcttcccttatctcatgcgtcatccctaaaataataagatacatgggatcaaatagcccttgccttttcaacacaaatcagttggaaaattatggtttgagtcctgttgctgccatggcttctgtttctcagaaatgagtgtgtatgaacataccaatctatgtaataggctacctttttttgtcttctttggaactttgtacacaaaccaagacaatatcagggtgacaggtgaatgaacttaaattctcagtcttgtctattcaccaaaaaagtatactgcctgttttttctttaattattcaaggttgatgacttttaggaacatgttttatactgtattttttaattaaagcaagtgccttgatgtaattccatgtaaatcattgcttaaccctcttatgggatgaggatgagttattaatgtattgcagcctactggaaaggagggggagttggttaatagcagatacttttcttctagaagcttatgttttatgctgtttattatgtaagatcctgtatgtgtgttgagatttagaggtttcatttgttttgtctgctaataaattgttactctaataata

SEQ ID NO: 426112 - DNA, 4006 bp, Homo sapiens
  misc_feature (825)..(825): n is a, c, g, or t
  misc_feature (956)..(956): n is a, c, g, or t
tttttcaatctgttcccagtttctaaacaattttaaatatttatgagaagcaaaccctatgtgtagggcatctgttggagtgggatgcttttagacatatattaagtatgtacatgtttaatatgtatatttaaaatgcatatatattttattatatctatattatcctatatagatatatgtaacttagctttattgttagctccataagctgccagtgttgcttttctgttggtagagctctcccatttggtgacatggaaaatacctttccattatcacaacaaagcagttgctcagtagaaagtctagatttctgtcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagctcatgcctgtaatcccagcacgttgggaggccgaggcgggtggatcacctgaagtcangagttcgagaccatcctggctaacactgtgaaaccccgtctctactaaaaatacaaaaaattagcggggcatggtggcacgcgcctgtagtcccagctactcaggaggctgaggcaggagaattacttgancccgggaggcggaggttgcagtaagcagagattgtgccactggactccagcctgggtgacagagcgagactccgtctcaaacaaacaaacaaaaaactgttttcatttgctctcttgaccaaaggataggactttagttctttaagcattattttaaacactatattgatacaaaaatatcttgcttactctaaactttagagtctaaatgaagctttttctcagtacaagattctgagtatcataaaatggttatttaattgaaacgtagtgtggtatactcttgatggttagaactcttacagccttatttatttttaagtttgttacagccaaagggttggagtgtgccagtgcacaggtagactaaggaaaacattatagaggagtgaagagaacagaccattgaaaagactattatctgaccagcggaggcagaaaagagaggaacccagttgaataggatccaatccctggttagcctctacacaataatagggagacaaggattaggagccatacctcccagagcaaggtatctttctagagcaaatttctctttctagaaggggagggtcacagggtcacagattcaccaaagctgaaagggctgaggagctcatggtagcctgggttgacctactctggagcacggtgtcttccttctaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaatttacatatggtaaatgatgaactttaaaaatgtgtccaggtgttagatgagttcattagactcttttaatgctaatggctagtacgtttaaacaaaacagcagttctctgctgcaatattcccattgaccacttaaatgaccataagtggtcatttaagaacatgttagggttagccctgatctgaatataaaagtgagaaaagggctacagtgcatttcttggtaacttaaactgagtcttgaagttataatgatccattcgagttctgtgatccttattgttcttaattgtgtttctctacgtattgttacagatgagccatacgtttctttgtatcaatgtagacatgacttcagatacctctgaggacctacccagcagtctaggaccctgggccaagtgctgggactatggtactaaatccagtagatgggctgtgtagcaactctcccagggaacacactagggtacttagggaggtgctttgtggagcatgttgaagctttgagatctgagcaggaggcagtgatgtccctggtctattcagggaaagatttcagtgtgaaatggtaaacatccaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagtttttttaattaaaaaaatagaaagctgttaggctcctaattcgtggggttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtggggagatttatttttataaggtaatttttatcctgataaggacttaaaaaaaagttttgcaactgaaattttaaagtaaacatgttaagtacagttaaaaagtaagcattgtagtaaatagtggattctctggtgtgtattttttatctcagtgttgaaaattggaaaagaatggactgaagtctaaaaactggaataatgaaggacactaaatgcctttattgtagatactatgtttgtaagtctatagctaagcaacttaagccaaaaaggtctttcaactgaagctttaatcaacttattttggagatgttctcttcccttatctcatgcgtcatccctaaaataataagatacatgggatcaaatagcccttgccttttcaacacaaatcagttggaaaattatggtttgagtcctgttgctgccatggcttctgtttctcagaaatgagtgtgtatgaacataccaatctatgtaataggctacctttttttgtcttctttggaactttgtacacaaaccaagacaatatcagggtgacaggtgaatgaacttaaattctcagtcttgtctattcaccaaaaaagtatactgcctgttttttctttaattattcaaggttgatgacttttaggaacatgttttatactgtattttttaattaaagcaagtgccttgatgtaattccatgtaaatcattgcttaaccctcttatgggatgaggatgagttattaatgtattgcagcctactggaaaggagggggagttggttaatagcagatacttttcttctagaagcttatgttttatgctgtttattatgtaagatcctgtatgtgtgttgagatttagaggtttcatttgttttgtctgctaataaattgttactctaataataaaaaaaaaaaaaaaaaaaaaagaaaaaaaaaaaagaatatgagcacaaagaaaacaaaaaaaaaaattgagaacacacacagaggaaagagaaacacaaaaacaaagaaaagacgacaaaaaccacaagaaaacaaagagaaagagaagaaagaaaaacaaaaagaaagggggagaacaacaataaaaaagagcaacaaagagacaaagcacaaaaaaagacaaaggaaaaga

SEQ ID NO: 426113 - DNA, 3571 bp, Homo sapiens
  misc_feature (825)..(825): n is a, c, g, or t
  misc_feature (956)..(956): n is a, c, g, or t
tttttcaatctgttcccagtttctaaacaattttaaatatttatgagaagcaaaccctatgtgtagggcatctgttggagtgggatgcttttagacatatattaagtatgtacatgtttaatatgtatatttaaaatgcatatatattttattatatctatattatcctatatagatatatgtaacttagctttattgttagctccataagctgccagtgttgcttttctgttggtagagctctcccatttggtgacatggaaaatacctttccattatcacaacaaagcagttgctcagtagaaagtctagatttctgtcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagctcatgcctgtaatcccagcacgttgggaggccgaggcgggtggatcacctgaagtcangagttcgagaccatcctggctaacactgtgaaaccccgtctctactaaaaatacaaaaaattagcggggcatggtggcacgcgcctgtagtcccagctactcaggaggctgaggcaggagaattacttgancccgggaggcggaggttgcagtaagcagagattgtgccactggactccagcctgggtgacagagcgagactccgtctcaaacaaacaaacaaaaaactgttttcatttgctctcttgaccaaaggataggactttagttctttaagcattattttaaacactatattgatacaaaaatatcttgcttactctaaactttagagtctaaatgaagctttttctcagtacaagattctgagtatcataaaatggttatttaattgaaacgtagtgtggtatactcttgatggttagaactcttacagccttatttatttttaagtttgttacagccaaagggttggagtgtgccagtgcacaggtagactaaggaaaacattatagaggagtgaagagaacagaccattgaaaagactattatctgaccagcggaggcagaaaagagaggaacccagttgaataggatccaatccctggttagcctctacacaataatagggagacaaggattaggagccatacctcccagagcaaggtatctttctagagcaaatttctctttctagaaggggagggtcacagggtcacagattcaccaaagctgaaagggctgaggagctcatggtagcctgggttgacctactctggagcacggtgtcttccttctaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaatttacatatggtaaatgatgaactttaaaaatgtgtccaggtgttagatgagttcattagactcttttaatgctaatggctagtacgtttaaacaaaacagcagttctctgctgcaatattcccattgaccacttaaatgaccataagtggtcatttaagaacatgttagggttagccctgatctgaatataaaagtgagaaaagggctacagtgcatttcttggtaacttaaactgagtcttgaagttataatgatccattcgagttctgtgatccttattgttcttaattgtgtttctctacgtattgttacagatgagccatacgtttctttgtatcaatgtagacatgacttcagatacctctgaggacctacccagcagtctaggaccctgggccaagtgctgggactatggtactaaatccagtagatgggctgtgtagcaactctcccagggaacacactagggtacttagggaggtgctttgtggagcatgttgaagctttgagatctgagcaggaggcagtgatgtccctggtctattcagggaaagatttcagtgtgaaatggtaaacatccaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagtttttttaattaaaaaaatagaaagctgttaggctcctaattcgtggggttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtggggagatttatttttataaggtaatttttatcctgataaggacttaaaaaaaagttttgcaactgaaattttaaagtaaacatgttaagtacagttaaaaagtaagcattgtagtaaatagtggattctctggtgtgtattttttatctcagtgttgaaaattggaaaagaatggactgaagtctaaaaactggaataatgaaggacactaaatgcctttattgtagatactatgtttgtaagtctatagctaagcaacttaagccaaaaaggtctttcaactgaagctttaatcaacttattttggagatgttctcttcccttatctcatgcgtcatccctaaaataataagatacatgggatcaaatagcccttgccttttcaacacaaatcagttggaaaattatggtttgagtcctgttgctgccatggcttctgtttctcagaaatgagtgtgtatgaacataccaatctatgtaataggctacctttttttgtcttctttggaactttgtacacaaaccaagacaatatcagggtgacaggtgaatgaacttaaattctcagtcttgtctattcaccaaaaaagtatactgcctgttttttctttaattattcaaggttgatgacttttaggaacatgttttatactgtattttttaattaaagcaagtggcccgccaatcgaagggtaccgag

SEQ ID NO: 426114 - DNA, 2896 bp, Homo sapiens
  misc_feature (825)..(825): n is a, c, g, or t
  misc_feature (956)..(956): n is a, c, g, or t
tttttcaatctgttcccagtttctaaacaattttaaatatttatgagaagcaaaccctatgtgtagggcatctgttggagtgggatgcttttagacatatattaagtatgtacatgtttaatatgtatatttaaaatgcatatatattttattatatctatattatcctatatagatatatgtaacttagctttattgttagctccataagctgccagtgttgcttttctgttggtagagctctcccatttggtgacatggaaaatacctttccattatcacaacaaagcagttgctcagtagaaagtctagatttctgtcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagctcatgcctgtaatcccagcacgttgggaggccgaggcgggtggatcacctgaagtcangagttcgagaccatcctggctaacactgtgaaaccccgtctctactaaaaatacaaaaaattagcggggcatggtggcacgcgcctgtagtcccagctactcaggaggctgaggcaggagaattacttgancccgggaggcggaggttgcagtaagcagagattgtgccactggactccagcctgggtgacagagcgagactccgtctcaaacaaacaaacaaaaaactgttttcatttgctctcttgaccaaaggataggactttagttctttaagcattattttaaacactatattgatacaaaaatatcttgcttactctaaactttagagtctaaatgaagctttttctcagtacaagattctgagtatcataaaatggttatttaattgaaacgtagtgtggtatactcttgatggttagaactcttacagccttatttatttttaagtttgttacagccaaagggttggagtgtgccagtgcacaggtagactaaggaaaacattatagaggagtgaagagaacagaccattgaaaagactattatctgaccagcggaggcagaaaagagaggaacccagttgaataggatccaatccctggttagcctctacacaataatagggagacaaggattaggagccatacctcccagagcaaggtatctttctagagcaaatttctctttctagaaggggagggtcacagggtcacagattcaccaaagctgaaagggctgaggagctcatggtagcctgggttgacctactctggagcacggtgtcttccttctaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaatttacatatggtaaatgatgaactttaaaaatgtgtccaggtgttagatgagttcattagactcttttaatgctaatggctagtacgtttaaacaaaacagcagttctctgctgcaatattcccattgaccacttaaatgaccataagtggtcatttaagaacatgttagggttagccctgatctgaatataaaagtgagaaaagggctacagtgcatttcttggtaacttaaactgagtcttgaagttataatgatccattcgagttctgtgatccttattgttcttaattgtgtttctctacgtattgttacagatgagccatacgtttctttgtatcaatgtagacatgacttcagatacctctgaggacctacccagcagtctaggaccctgggccaagtgctgggactatggtactaaatccagtagatgggctgtgtagcaactctcccagggaacacactagggtacttagggaggtgctttgtggagcatgttgaagctttgagatctgagcaggaggcagtgatgtccctggtctattcagggaaagatttcagtgtgaaatggtaaacatccaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagtttttttaattaaaaaaatagaaagctgttaggctcctaattcgtggggttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtgtagaaaatgaacgggatcctctaga

SEQ ID NO: 426115 - DNA, 2820 bp, Homo sapiens
  misc_feature (825)..(825): n is a, c, g, or t
  misc_feature (956)..(956): n is a, c, g, or t
  misc_feature (2800)..(2800): n is a, c, g, or t
  misc_feature (2804)..(2804): n is a, c, g, or t
  misc_feature (2808)..(2808): n is a, c, g, or t
tttttcaatctgttcccagtttctaaacaattttaaatatttatgagaagcaaaccctatgtgtagggcatctgttggagtgggatgcttttagacatatattaagtatgtacatgtttaatatgtatatttaaaatgcatatatattttattatatctatattatcctatatagatatatgtaacttagctttattgttagctccataagctgccagtgttgcttttctgttggtagagctctcccatttggtgacatggaaaatacctttccattatcacaacaaagcagttgctcagtagaaagtctagatttctgtcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagctcatgcctgtaatcccagcacgttgggaggccgaggcgggtggatcacctgaagtcangagttcgagaccatcctggctaacactgtgaaaccccgtctctactaaaaatacaaaaaattagcggggcatggtggcacgcgcctgtagtcccagctactcaggaggctgaggcaggagaattacttgancccgggaggcggaggttgcagtaagcagagattgtgccactggactccagcctgggtgacagagcgagactccgtctcaaacaaacaaacaaaaaactgttttcatttgctctcttgaccaaaggataggactttagttctttaagcattattttaaacactatattgatacaaaaatatcttgcttactctaaactttagagtctaaatgaagctttttctcagtacaagattctgagtatcataaaatggttatttaattgaaacgtagtgtggtatactcttgatggttagaactcttacagccttatttatttttaagtttgttacagccaaagggttggagtgtgccagtgcacaggtagactaaggaaaacattatagaggagtgaagagaacagaccattgaaaagactattatctgaccagcggaggcagaaaagagaggaacccagttgaataggatccaatccctggttagcctctacacaataatagggagacaaggattaggagccatacctcccagagcaaggtatctttctagagcaaatttctctttctagaaggggagggtcacagggtcacagattcaccaaagctgaaagggctgaggagctcatggtagcctgggttgacctactctggagcacggtgtcttccttctaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaatttacatatggtaaatgatgaactttaaaaatgtgtccaggtgttagatgagttcattagactcttttaatgctaatggctagtacgtttaaacaaaacagcagttctctgctgcaatattcccattgaccacttaaatgaccataagtggtcatttaagaacatgttagggttagccctgatctgaatataaaagtgagaaaagggctacagtgcatttcttggtaacttaaactgagtcttgaagttataatgatccattcgagttctgtgatccttattgttcttaattgtgtttctctacgtattgttacagatgagccatacgtttctttgtatcaatgtagacatgacttcagatacctctgaggacctacccagcagtctaggaccctgggccaagtgctgggactatggtactaaatccagtagatgggctgtgtagcaactctcccagggaacacactagggtacttagggaggtgctttgtggagcatgttgaagctttgagatctgagcaggaggcagtgatgtccctggtctattcagggaaagatttcagtgtgaaatggtaaacatccaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagtttttttaattaaaaaaatagaaagctgttaggctcctaattcgtggggttttttttgtaaaaacagtttagataatcctgaatgcaatcattaacttggttgctaattacaagaatgaaaattataatggaaaaggacaaaataatataccagctggtttgttattatagtccgtgtattaaaatactattgaacttctanactngggnccggctcgatga

SEQ ID NO: 426116 - DNA, 2111 bp, Homo sapiens
  misc_feature (825)..(825): n is a, c, g, or t
  misc_feature (956)..(956): n is a, c, g, or t
tttttcaatctgttcccagtttctaaacaattttaaatatttatgagaagcaaaccctatgtgtagggcatctgttggagtgggatgcttttagacatatattaagtatgtacatgtttaatatgtatatttaaaatgcatatatattttattatatctatattatcctatatagatatatgtaacttagctttattgttagctccataagctgccagtgttgcttttctgttggtagagctctcccatttggtgacatggaaaatacctttccattatcacaacaaagcagttgctcagtagaaagtctagatttctgtcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagctcatgcctgtaatcccagcacgttgggaggccgaggcgggtggatcacctgaagtcangagttcgagaccatcctggctaacactgtgaaaccccgtctctactaaaaatacaaaaaattagcggggcatggtggcacgcgcctgtagtcccagctactcaggaggctgaggcaggagaattacttgancccgggaggcggaggttgcagtaagcagagattgtgccactggactccagcctgggtgacagagcgagactccgtctcaaacaaacaaacaaaaaactgttttcatttgctctcttgaccaaaggataggactttagttctttaagcattattttaaacactatattgatacaaaaatatcttgcttactctaaactttagagtctaaatgaagctttttctcagtacaagattctgagtatcataaaatggttatttaattgaaacgtagtgtggtatactcttgatggttagaactcttacagccttatttatttttaagtttgttacagccaaagggttggagtgtgccagtgcacaggtagactaaggaaaacattatagaggagtgaagagaacagaccattgaaaagactattatctgaccagcggaggcagaaaagagaggaacccagttgaataggatccaatccctggttagcctctacacaataatagggagacaaggattaggagccatacctcccagagcaaggtatctttctagagcaaatttctctttctagaaggggagggtcacagggtcacagattcaccaaagctgaaagggctgaggagctcatggtagcctgggttgacctactctggagcacggtgtcttccttctaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaatttacatatggtaaatgatgaactttaaaaatgtgtccaggtgttagatgagttcattagactcttttaatgctaatggctagtacgtttaaacaaaacagcagttctctgctgcaatattcccattgaccacttaaatgaccataagtggtcatttaagaacatgttagggttagccctgatctgaatataaaagtgagaaaagggctacagtgcatttcttggtaacttaaactgagtcttgaagttataatgatccattcgagttcgactagttctagatcgcgagcggccggcccttttttttttttttggggtttttttttttttttt

SEQ ID NO: 426117 - DNA, 1813 bp, Homo sapiens
  misc_feature (825)..(825): n is a, c, g, or t
  misc_feature (956)..(956): n is a, c, g, or t
tttttcaatctgttcccagtttctaaacaattttaaatatttatgagaagcaaaccctatgtgtagggcatctgttggagtgggatgcttttagacatatattaagtatgtacatgtttaatatgtatatttaaaatgcatatatattttattatatctatattatcctatatagatatatgtaacttagctttattgttagctccataagctgccagtgttgcttttctgttggtagagctctcccatttggtgacatggaaaatacctttccattatcacaacaaagcagttgctcagtagaaagtctagatttctgtcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagctcatgcctgtaatcccagcacgttgggaggccgaggcgggtggatcacctgaagtcangagttcgagaccatcctggctaacactgtgaaaccccgtctctactaaaaatacaaaaaattagcggggcatggtggcacgcgcctgtagtcccagctactcaggaggctgaggcaggagaattacttgancccgggaggcggaggttgcagtaagcagagattgtgccactggactccagcctgggtgacagagcgagactccgtctcaaacaaacaaacaaaaaactgttttcatttgctctcttgaccaaaggataggactttagttctttaagcattattttaaacactatattgatacaaaaatatcttgcttactctaaactttagagtctaaatgaagctttttctcagtacaagattctgagtatcataaaatggttatttaattgaaacgtagtgtggtatactcttgatggttagaactcttacagccttatttatttttaagtttgttacagccaaagggttggagtgtgccagtgcacaggtagactaaggaaaacattatagaggagtgaagagaacagaccattgaaaagactattatctgaccagcggaggcagaaaagagaggaacccagttgaataggatccaatccctggttagcctctacacaataatagggagacaaggattaggagccatacctcccagagcaaggtatctttctagagcaaatttctctttctagaaggggagggtcacagggtcacagattcaccaaagctgaaagggctgaggagctcatggtagcctgggttgacctactctggagcacggtgtcttccttctaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaaagcaaagtcagactatctaaatcttgttttccttt

SEQ ID NO: 426118 - DNA, 1786 bp, Homo sapiens
gtgtaacctgagattcatcatgggaatgagaaagtaaagtccctttataatggcatgtgaaccagacaatttagtagccagggttgtaaggcaactcttaactgacaatatagttagtatattctgggccttcatcttcaaaattagtaggtagtatttattgagtgcatatcatgtgccaggcctggtgctgagtgcttacaatgatcattttatatatgggaaaattgaggctcagcagggtcaagtgccttgtaagaggtagcactagtaagtaacagtgctcaaattcaactaggtctttcagctttttatacaatactgcctgttatcagaaagtatagtcttaaaatctgctatcaagcatctatcagaagcctgatgagaaatattcagatgatctaacgcagttcccaaacctgcattgtgggccgttttcattacaattacctaaggtgctttaaaaattttcttgggccctactcgttgtggttcagcagctgtgtaatggagcaaaaaggaatagtcactaaacagcgaaggaaagtggtggaattattaaaagacctagcacttacctgctgggatgagtctctaaccccacagaattgatttcaaacacaggatcttattcaagataaggataataacagctatcttcttgggttgtaaaaagtagcattagactgcattttaaacatttggtatgattttgaggacataaccgtaaacagctatttaatactattccaggtagtcaaaggccaatgtataaaagttaaaaatataggtcttgtcagctttttaagcgtctgtcccactgactaccatatctctacaagagaatagatgaggaattgaggttatgtgggaagtacgtgtaagtttacagtattaagaaatgtacaataaaatttgtttctatgtcagcgtatattcttgactcaaggagtttgaaagtgtaaactcaaaggtctttcacatgtaaagaggaacctctccattctgtacttgtatagtcattacctcatatagatttaattttattaaattaaattttacttattttgggtttaaaaaaacttgggctgtgaatctcagttttaagtcatgggcaaatttgataaaaattcctttctgtctacatgtaatactgaaaaaaatgttgataaggtaaagctatctccatttagattgatacccattaaatagcatagtgctcccattaaactagcgacaaattcatttaattgtgagatatctagtacttatgctccatcctgtttatagggattattgatgtgagatttggtcagatgctttgatgtgatcttcattcctctgtatagtgggaaaccatgagacgtgcttagtcttcataaatcgatgctgcctcctagtggccattgctttcttttctacctgtccacaaacttcaaaaaaatagattttggaattttgtcagggacacttatcaagccattaatacatgccaggcagtgtgctcaaagctgtggataggccagggaacagtattcttgtgcttgtgaagcttctatctgtctgtatctacctcaaccaaatcatcttgactcagatttactgtcgaaggtcgtgttatttcatcagattctttcagtattctgggatataatttatgggttctggattcattcaaaacaactagaaacagtctttttaaaataaatataattcaagtcaattattttccccatctattttttttcttttaagattgctaagtctgtaggttgcataattctaa

SEQ ID NO: 426119 - DNA, 581 bp, Homo sapiens
agcgggtgggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgagactctcccaccccaaactccaacctgtatcagatgcagcccccaagcccttagactctaagcccagttagcaaggtgccgggtcaccctgcaggttcccataaaaacgatttgcag

SEQ ID NO: 426120 - DNA, 469 bp, Homo sapiens
agcgggtgggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgcttagactctaagcccagttagcaaggtgccgggtcaccctgcaggttcccataaaaacgatttgcag

SEQ ID NO: 426121 - DNA, 1086 bp, Homo sapiens
agcgggtgggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccccgcctgcctcagcctcccaaagtgctgggattacagctcgccctcccctacctgcggaagagtcaagggaatgtcatcaacatctccagcctggtgggggcaatcggccaggcccaggcagttccctatgtggccaccaagggggcagtaacagccatgaccaaagctttggccctggatgaaagtccatatggtgtccgagtcaactgccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcag

SEQ ID NO: 426122 - DNA, 1146 bp, Homo sapiens
agcgggtgggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccctcgccctcccctacctgcggaagagtcaagggaatgtcatcaacatctccagcctggtgggggcaatcggccaggcccaggcagttccctatgtggccaccaagggggcagtaacagccatgaccaaagctttggccctggatgaaagtccatatggtgtccgagtcaactgtatctccccaggaaacatctggaccccgctgtgggaggagctggcagccttaatgccagaccctagggccacaatccgagagggcatgctggcccagccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcag

SEQ ID NO: 426123 - DNA, 1049 bp, Homo sapiens
agcgggtgggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccctcgccctcccctacctgcggaagagtcaagggaatgtcatcaacatctccagcctggtgggggcaatcggccaggcccaggcagttccctatgtggccaccaagggggcagtaacagccatgaccaaagctttggccctggatgaaagtccatatggtgtccgagtcaactgccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcag

SEQ ID NO: 426124 - DNA, 981 bp, Homo sapiens
agcgggtgggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccctcgccctcccctacctgcggaagagtcaagggaatgtcatcaacatctccagcctggtgggggcaatcggccaggcccaggcagttccctatgtggccaccaagccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcag

SEQ ID NO: 426125 - DNA, 861 bp, Homo sapiens
agcgggtgggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccactgggttctagtgagagacaattccgctcgcattatggcacagctcgtgggattatgtggttggtcgaatcgaagctgctgggcgcagacaagtccacctcgcgcagtagtatgagcctgacggaggaccatcgtgtcgcgaggggtattcctgccaaagggtggcgttggaagctagaagcctatctggggggaacagtacaccttatgaatcaatgctcgcaccgtccctctacctaggacgggaaagacgtcaaggcgaaagtcgtcactacaacatcttccaagaccttgagtaggaggagcaactccggggagaaagtgcccccaaggccaagatttcccgctattgctgtgcccacccaaaggtggg

SEQ ID NO: 426126 - DNA, 1238 bp, Homo sapiens
agcgggtgggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaagctcgccctcccctacctgcggaagagtcaagggaatgtcatcaacatctccagcctggtgggggcaatcggccaggcccaggcagttccctatgtggccaccaagggggcagtaacagccatgaccaaagctttggccctggatgaaagtccatatggtgtccgagtcaactgtatctccccaggaaacatctggaccccgctgtgggaggagctggcagccttaatgccagaccctagggccacaatccgagagggcatgctggcccagccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcag

SEQ ID NO: 426127 - DNA, 1031 bp, Homo sapiens
agctggtaccggtccggagtcttttggatgcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaagctcgccctcccctacctgcggaagagtcaagggaatgtcatcaacatctccagcctggtgggggcaatcggccaggcccaggcagttccctatgtggccaccaagggggcagtaacagccatgaccaaagctttggccctggatgaaagtccatatggtgtccgagtcaactgtatctccccaggaaacatctggaccccgctgtgggaggagctggcagccttaatgccagaccctagggccacaatccgagagggcatgctggcccagccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcag

SEQ ID NO: 426128 - DNA, 1261 bp, Homo sapiens
agcgggtgggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaagctcgccctcccctacctgcggaagagtcaagggaatgtcatcaacatctccagcctggtgggggcaatcggccaggcccaggcagttccctatgtggccaccaagggggcagtaacagccatgaccaaagctttggccctggatgaaagtccatatggtgtccgagtcaactgtatctccccaggaaacatctggaccccgctgtgggaggagctggcagccttaatgccagaccctagggccacaatccgagagggcatgctggcccaggtagaagtggggttcagatccagccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcag

SEQ ID NO: 426129 - DNA, 1059 bp, Homo sapiens
agcgggtgggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccctcgccctcccctacctgcggaagagtcaagggaatgtcatcaacatctccagcctggtgggggcaatcggccaggcccaggcagttccctatgtggccaccaagtctcatctatagggggcagttacagccagagacgcagaagactaggacagggatggaagtctatatcggttgtaactgactcagagataggcaatagcgacgtgagcttgggccaagagccgatagagacgatcgaaggagcaatgcgggcaaaagtatacgctggactccgaagcagatatgtaggtaagggcaatgcactgctcgtgagcacaggcaagcagaagagggagcaacgacgagcaagaggctacggaggagaacccagctggaaccggactccgatagccctgctggaaagtatcagtcatatgctatcgcgcggcaccatgtaagaggaatgtctacagactaactccaacttgactagaagcaggctcaagacaacaacgtgtagcaagta

SEQ ID NO: 426130 - DNA, 222 bp, Homo sapiens
tgaacagcggggcccgagtggttatctgcgacaaggatgtggtgagtgacggtccctcagccctcaccttggcccttcctccctcagacccagaggtccagacccctagcacctcctccctcagaccccggagtccaggcccccaggccctacttcctcagacccaggagtccagacctcagcccctcctccctcagacctaggagtccaggcccccagccc

SEQ ID NO: 426131 - DNA, 397 bp, Homo sapiens
gcacgagatagtgtcaggatttgaaggagctatatgacataaaaagaacttttggcaaatatttattcagattgcttgtctccagtgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagcc

SEQ ID NO: 426132 - DNA, 355 bp, Homo sapiens
gagatggaatttcgctcttttgcccaggctggagtgcaatggcatgatctcagctcaccgcaacctccacctcccgggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagcc

SEQ ID NO: 426133 - DNA, 2338 bp, Homo sapiens
tctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgaaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctagaaatatttaagagcagctcagcttggttgaaactgagttttgtcatcttccatatttgcaggaaggtattttctgacttgcaatgcagctagatgtaaaattttattttatcatactagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagcc

SEQ ID NO: 426134 - DNA, 1957 bp, Homo sapiens
gagagagagaactagttctctctctccacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgaaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctagaaatatttaagagcagctcagcttggttgaaactgagttttgtcatcttccatatttgcaggaaggtattttctgacttgcaatgcagctagatgtaaaattttattttatcatactagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagcc

SEQ ID NO: 426135 - DNA, 2280 bp, Homo sapiens
tctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgaaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctagaaatatttaagagcagctcagcttggttgaaactgagttttgtcatcttccatatttgcaggaaggtattttctgacttgcaatgcagctagatgtaaaattttattttatcatactagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagcc

SEQ ID NO: 426136 - DNA, 2284 bp, Homo sapiens
tctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgaaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctagaaatatttaagagcagctcagcttggttgaaactgagttttgtcatcttccatatttgcaggaaggtattttctgacttgcaatgcagctagatgtaaaattttattttatcatactagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagcc

SEQ ID NO: 426137 - DNA, 969 bp, Homo sapiens
gttgtcgtgcaggtagaggctgattgtagtttctctactagaaaaataataagatgtattattaaaacgtgagttgagaataatattcctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagcc

SEQ ID NO: 426138 - DNA, 2484 bp, Homo sapiens
  misc_feature (2340)..(2354): n is a, c, g, or t
  misc_feature (2356)..(2358): n is a, c, g, or t
  misc_feature (2440)..(2440): n is a, c, g, or t
  misc_feature (2452)..(2452): n is a, c, g, or t
  misc_feature (2470)..(2470): n is a, c, g, or t
  misc_feature (2474)..(2474): n is a, c, g, or t
  misc_feature (2477)..(2477): n is a, c, g, or t
  misc_feature (2480)..(2480): n is a, c, g, or t
tctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgaaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctagaaatatttaagagcagctcagcttggttgaaactgagttttgtcatcttccatatttgcaggaaggtattttctgacttgcaatgcagctagatgtaaaattttattttatcatactagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagcccnnnnnnnnnnnnnnngnnnactcgcattcttggtcagagtttagagagatgtaagactttcaattaatgcctaattaactccttaatgtgattagcttggntacatgtctgantcagaacctaattaaggnattnttnaantgta

SEQ ID NO: 426139 - DNA, 2283 bp, Homo sapiens
tctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgaaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctagaaatatttaagagcagctcagcttggttgaaactgagttttgtcatcttccatatttgcaggaaggtattttctgacttgcaatgcagctagatgtaaaattttattttatcatactagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagcc

SEQ ID NO: 426140 - DNA, 2419 bp, Homo sapiens
tctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgaaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctagaaatatttaagagcagctcagcttggttgaaactgagttttgtcatcttccatatttgcaggaaggtattttctgacttgcaatgcagctagatgtaaaattttattttatcatactagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagccaaataaaaaaaaaatggcaacaaccaagcacgaatacaaacaaaagagcacaagagaagaggggagcgggaataaaaacgc

SEQ ID NO: 426141 - DNA, 2255 bp, Homo sapiens
atcgaagagaaatctagaggatcccgggagagagatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgaaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctagaaatatttaagagcagctcagcttggttgaaactgagttttgtcatcttccatatttgcaggaaggtattttctgacttgcaatgcagctagatgtaaaattttattttatcatactagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagcc

SEQ ID NO: 426142 - DNA, 878 bp, Homo sapiens
agcgggataacagccacacgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtctgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagca

SEQ ID NO: 426143 - DNA, 904 bp, Homo sapiens
  misc_feature (886)..(886): n is a, c, g, or t
  misc_feature (897)..(897): n is a, c, g, or t
agcgggataacagccacacgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtctgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagcaaaaaaaanagaaaaatccncagcgcc

SEQ ID NO: 426144 - DNA, 300 bp, Homo sapiens
agcgggataacagccacacgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtttgcggggccaagtgttgcggcgacgcacctcacgtcgagaatcgggaggaggagactgcaaggataggcccaggagtaatggagtccaagaggaacgagcgatctacagtgcagggatcctctataatccc

SEQ ID NO: 426145 - DNA, 842 bp, Homo sapiens
agcgggataacagccacacgtgatcggccaacactgagtcttacctcgttgtggcgtcagaaccgccgtcgctcgctcccttctcggcagtggtacctgttcccggtgtccctgaggacgtgcgggccaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtctgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagca

SEQ ID NO: 426146 - DNA, 1169 bp, Homo sapiens
agcgggataacagccacacgtgatcggccaacactgagtcttacctcgttgtggcgtcagaaccgccgtcgctcgctcccttctcggcagtggtacctgttcccggtgtccctgaggacgtgcgggccaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtctgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagcaaaaaaaaaaaaaagggggggggcataagagtttcttcggggggccaactaacgcgtacccagcgtttcgtgtcacaacggtggcccaatataggtgatcggaatataaatacgctagagacgggccgcgcgctttaaaaagctctggtaggtggcaaacgtgccacgtgggaacattgggtgacgaaaccatgctcgtcggcgggaacaactgggcaaacacctctgagacatccagccgccaggtcaaactatcaagttaaggctacatagtgtgaacacggcatatatagcgggagacaatgtgatcggatatatataggtatag

SEQ ID NO: 426147 - DNA, 1681 bp, Homo sapiens
agcgggataacagccacacgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtaagggacccggagggggtccctggggttggtgtgggggagcagccccggcctgcggatgccccatccccgggcagcagcgcggagacgcagccggtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgctccgcccttcttgatgcagaaaatggtggtcagcttggggggctgggcggctgaggcggggggcgagagcggctaggagggcccgggcccggcgtggggaaggggccgggtggcggcgggtcctctctagcgttccgctgcagcagcccccactcttcccaccccggcgtctgcaggtttgcggggccaagtgttgcggcgacgcacctcacgtcgagaatcgggaggaggagactgcaaggataggcccaggtcagtgcgagggacggtggtggggagggggtcagaacatgaggaaagcccagtctgagaccccaatccgtgccttccaccccgcacacttagcaatcccccacccccaccccttcttcgtcctccattttggtgcctgcagaggcctggagatggatctgcagagaagatggtgggctttgcgggagagaagggcacagactggctcccctcgcccccccgagggtacatggggcctctctggtggaaaaaaaatgaaatttaaaaaaggcctttgaaatccagggctctgaattttgaaaggtgggtagtcgggcctctgtcctcggtgctgatcagttcaccaagaattgagtccattttctctctgtctcctaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtctgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagca

SEQ ID NO: 426148 - DNA, 1814 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaa

SEQ ID NO: 426149 - DNA, 2272 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatcta

SEQ ID NO: 426150 - DNA, 2189 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatcta

SEQ ID NO: 426151 - DNA, 2229 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatcta

SEQ ID NO: 426152 - DNA, 2053 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcagggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatcta

SEQ ID NO: 426153 - DNA, 1992 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatcta

SEQ ID NO: 426154 - DNA, 1794 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcagggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacattggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatcta

SEQ ID NO: 426155 - DNA, 878 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtggctaaccattaagaggccgagaaaataagattgcaccagcaaaggagacaaacgaaggatggatcagtactgcaggagggaagctaagaactaagagtgaaagccacgtgaagaaagtgtttctggggaaggaagtagaccagctgggtcagatgctgctgatgggctcctgggttcaagcgattctcctgcctcagcctctcgccgagtggctgggtttacaggcatgtgccaccacgcctggctaattttgtattttcagtagagacggggtttctccatgttggtcagcctggtcttgagctcccgccctcaggtgatccgcctgccttggcctcccaaagtgctgggattacaggcgtgagccactgcgcctggcctggaattacttttctaactttgtttatgcctgaatcaaaaacgattaatgaaattatatcgtcatacatagtattgtataacttaattttttaagaagcaaatatggcataatagctgaaaaaaaaggttctgtagtaaagcttaactatgaatgccatcatcaatcgaactataaaacagggacaataacaatgcctcacttaactgggttcttgtgggaagtaaatgtgattatatttgtggagcatctagcataatggaacgttgtagtaagaccataattattcatttctgtctcaag

SEQ ID NO: 426156 - DNA, 418 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtggaagcgtgacagtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagaga

SEQ ID NO: 426157 - DNA, 2013 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacattggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatcta

SEQ ID NO: 426158 - DNA, 2162 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgctagacttcgacttcaggcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatcta

SEQ ID NO: 426159 - DNA, 2207 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggatttgttcaagttgaaattgtaaacctatgccagaacttgcatgaagagatgagtaagattagctttcaatagtaattcaaagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatcta

SEQ ID NO: 426160 - DNA, 854 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgagggtgagtgctggagttctct

SEQ ID NO: 426161 - DNA, 774 bp, Homo sapiens
aagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtggctaaccattaagaggccgagaaaataagattgcaccagcaaaggagacaaacgaaggatggatcagtactgcaggagggaagctaagaactaagagtgaaagccacgtgaagaaagtgtttctggggaaggaagtagaccagctgggtcagatgctgctgatgggggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggactggtgaggaatattttaatatctcaagatggtgttaaattgggatcatatgttttcaaaaaagaagcacctggctcattgtattgttctactctgaggcaaccttggggggccaagatccccatcctta

SEQ ID NO: 426162 - DNA, 1598 bp, Homo sapiens
aacattcctgcaaatggtttcaatatatgcagatgtctcgatataggaatgaaattacgtctttggaacaacttaaataagtcaaatatacttggagctttaaaaattaaaaggagagagattcgagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcttaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgaggcaacagcacttgaaagtttttcattcatcataagaactttatataaaggcattacattggcaaataaggtttggaagcagaagagcaaaaaaaagatattgttaaaatgaggcctccatgcaaaacacatacttccctcccatttatttaactttttttttctcctacctatggggaccaaagtgctttttccttcaggaagtggagatgcatggccatctccccctccctttttccttctcctgcttttctttccccatagaaagtaccttgaagtagcacagtccgtccttgcatgtgcacgagctatcatttgagtaaaagtatacatggagtaaaaatcatattaagcatcagattcaacttatattttctatttcatcttcttcctttcccttctcccaccttctactgggcataattatatcttaatcatatatggaaatgtgcaacatatggtatttgttaaatacgtttgtttttattgcagagcaaaaataaatcaaattagaagcaa

SEQ ID NO: 426163 - DNA, 1131 bp, Homo sapiens
aattctcagcacagcctttaaggttccaaacatctgctagaagaggaatgcagatttaaactgagtgaggtgtggagtgggggaagttgattgggtctagaccaaagaactttgaggaacttgcccagagccctgcatgcatcagacctacagcagacattgcaggcctgaagaaagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcttaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgagg

SEQ ID NO: 426164 - DNA, 1648 bp, Homo sapiens
aattctcagcacagcctttaaggttccaaacatctgctagaagaggaatgcagatttaaactgagtgaggtgtggagtgggggaagttgattgggtctagaccaaagaactttgaggaacttgcccagagccctgcatgcatcagacctacagcagacattgcaggcctgaagaaagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcttaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgaggcaacagcacttgaaagtttttcattcatcataagaactttatataaaggcattacattggcaaataaggtttggaagcagaagagcaaaaaaaagatattgttaaaatgaggcctccatgcaaaacacatacttccctcccatttatttaactttttttttctcctacctatggggaccaaagtgctttttccttcaggaagtggagatgcatggccatctccccctccctttttccttctcctgcttttctttccccatagaaagtaccttgaagtagcacagtccgtccttgcatgtgcacgagctatcatttgagtaaaagtatacatggagtaaaaatcatattaagcatcagattcaacttatattttctatttcatcttcttcctttcccttctcccaccttctactgggcataattatatcttaatcatatatggaaatgtgcaacatatggtatttgttaaatacgtttgtttttattgcagagcaaaaataaatcaaattagaagcaa

SEQ ID NO: 426165 - DNA, 1557 bp, Homo sapiens
aacattcctgcaaatggtttcaatatatgcagatgtctcgatataggaatgaaattacgtctttggaacaacttaaataagtcaaatatacttggagctttaaaaattaaaaggagagagattcgagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcttaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgagggcaaaccagcaaaaaaaaaaaaaaacaaaacatcaaaaaaaacacacacaaaaatgattttccacaaaacacaacaaacacaaaagaaccaacaaaaacactgtgtgtgtgcggcgcgcgcgccagccccccccccagaagaaacttttctccacacaccaagacgtgtgggcggcggcgcggcggggagcacccaaattatgagttgaagaagcaacatcgtgcgacaaatcggggtgctcaccgcaaggaagaagagccatccgtggggagcaacacaacgtcgggggtgggtgcgtcctccccccaaaaaaaaaaaaaaagccggcgggcggggaagacgaaaccaggtgttttgatgacgaacaaacacacccaaggaggtggcgtacgacaggaggacagaaaagcagggaggcgttcaacacacgaacgagggtgctcccaagccggcggcctgaatcaaaaattacccg

SEQ ID NO: 426166 - DNA, 1081 bp, Homo sapiens
aacattcctgcaaatggtttcaatatatgcagatgtctcgatataggaatgaaattacgtctttggaacaacttaaataagtcaaatatacttggagctttaaaaattaaaaggagagagattcgagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcttaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgagg

SEQ ID NO: 426167 - DNA, 514 bp, Homo sapiens
  misc_feature (503)..(503): n is a, c, g, or t
aattctcagcacagcctttaaggttccaaacatctgctagaagaggaatgcagatttaaactgagtgaggtgtggagtgggggaagttgattgggtctagaccaaagaactttgaggaacttgcccagagccctgcatgcatcagacctacagcagacattgcaggcctgaagaaagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttatatttttccggctccttgttccttaggccgcangaattagcaat

SEQ ID NO: 426168 - DNA, 1439 bp, Homo sapiens
aacattcctgcaaatggtttcaatatatgcagatgtctcgatataggaatgaaattacgtctttggaacaacttaaataagtcaaatatacttggagctttaaaaattaaaaggagagagattcgagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctgggtctggatggcatggtgctcctcttaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgaggcaacagcacttgaaagtttttcattcatcataagaactttatataaaggcattacattggcaaataaggtttggaagcagaagagcaaaaaaaagatattgttaaaatgaggcctccatgcaaaacacatacttccctcccatttatttaactttttttttctcctacctatggggaccaaagtgctttttccttcaggaagtggagatgcatggccatctccccctccctttttccttctcctgcttttctttccccatagaaagtaccttgaagtagcacagtccgtccttgcatgtgcacgagctatcatttgagtaaaagtatacatggagtaaaaatcatattaagcatcagattcaacttatattttctatttcatcttcttcctttcccttctcccaccttctactgggcataattatatcttaatcatatatggaaatgtgcaacatatggtatttgttaaatacgtttgtttttattgcagagcaaaaataaatcaaattagaagcaa

SEQ ID NO: 426169 - DNA, 9003 bp, Homo sapiens
cccaggggctcaagccgcacgtgagaaagtctgggcatctgggattcggagagtatagcctgtgagccgctttcccctccttactgtcggttgcatcccttcgacactcccgaggccgtcgcgggccactggccctctgcagccatgaagacaaagcccgtttcccacaagaccgagaacacctaccggtttcttacatttgctgaacgactggggaatgttaatattgatattattcaccggattgatagaactgcaagctatgaggaggaggttgaaacctacttttttgagggtctgctgaaatggagagaattaaacctcacagaacacttcggaaaattttacaaagaagttattgacaaatgccaatcattcaatcagttggtgtatcaccaaaacgagatagttcagagtttgaagactcacctgcaagttaagaacagttttgcctatcaaccccttttggatttggttgtacagttggcacgagatctgcagatggatttctacccacactttccagagttttttttgactatcacctcgatcctggagactcaggacacagagttgttagaatgggctttcacctcgttatcatatctttataagtacctgtggagactgatggtgaaggacatgtccagtatatacagcatgtacagcacactcctggctcataaaaaactacatataagaaattttgctgctgaaagttttacttttttgatgagaaaggtctctgataaaaacgcacttttcaatttaatgtttcttgatcttgataaacatccagaaaaagttgaaggtgttggacagttgctctttgaaatgtgcaaaggagttagaaatatgtttcactcctgtacaggccaggcagtgaagctaattttgcgaaagctaggaccagtcactgaaacagaaactcaactaccatggatgttaattggagaaacactcaaaaacatggtcaaatccactgtatcctacatctccaaggaacattttggtacattttttgaatgtttgcaagaatcgctcttggatctacacacaaaagtaacaaaaactaactgttgtgaaagttctgaacagattaaaaggttgttggaaacataccttatacttgtaaaacatggaagtgggacaaagatacccacgcctgctgatgtctgtaaggtgttatctcaaacactgcaagtagccagtctctccacatcttgctgggagaccctcttggatgtaatttctgctttgatcctgggtgaaaatgtttccttgccggagaccctcatcaaagaaaccatagaaaaaatatttgagagcagatttgaaaaacgtttaattttcagtttttctgaagtcatgtttgccatgaagcagtttgagcagctttttctaccaagctttctgtcatatattgtgaattgcttcttaattgatgatgctgtagtcaaagatgaagctctggccattctggccaagctcattctgaacaaagcagcacctcccactgctggctcgatggcaattgaaaagtaccctctggttttctcaccgcagatggtgggattctatataaagcagaagaagactagatccaagggaagaaacgaacagtttccagtattggaccatcttttatctataattaagttacccccaaataaagatactacttacctttcacaatcttgggcagccctcgtggtgttacctcatattagacctcttgagaaagagaaggtgataccactcgtcaccggcttcatagaggcactcttcatgactgttgacaaaggaagctttgggaaaggaaacttatttgttctttgtcaagctgtaaatactctactaagtttggaagaatcttctgaacttcttcatttggttcctgtggaacgtgtgaagaatttagtattaacctttcccctggagccatctgtgttgctgttgactgatctctattatcagagattagccttgtgtggctgcaaagggccactttcccaggaggctttaatggaattatttcccaagttacaagcaaacatttcaactggtgtatccaagattcggcttttgacaataaggatcctaaaccattttgatgtccagcttccagaatcaatggaggatgatgggctctcagagcggcagtctgtctttgctatattacgccaggcagaacttgttccagcaactgtgaatgattatagagagaagcttcttcatttgagaaaactaagacatgatgtggtacagactgctgtccctgatgggccgttacaggaggtgccgcttcgttatttgttaggcatgctatatattaatttcagtgcactctgggatcctgttattgaactcataagttctcatgcacacgaaatggaaaataagcaattttggaaagtctactatgagcatctagaaaaagcagctacgcatgctgagaaggaactacagaatgatatgacagatgagaagtccgttggagatgaaagttgggagcagacccaggaaggagatgttggagctctttatcatgagcagttagcattgaaaactgactgtcaggaaagacttgaccacaccaacttcagattcctgctctggagagctctgaccaaattcccagaaagagtagagccacggtccagggagctttccccgcttttcttgagatttatcaacaatgagtattacccagcagatctgcaagttgctccaacccaggatctacggagaaaaggcaaagggatggtggcagaggaaatcgaagaggaacctgccgcaggagatgatgaagagttggaggaagaggcagtgccccaagatgaatcctcacagaagaaaaagacgaggagagctgcagcaaagcaattaattgctcatttgcaagttttctctaaattttcaaatccacgggccttatatctggaatccaaactatatgagttatatcttcagttgttgctacaccaagatcaaatggtgcaaaaaataaccttggattgcataatgacatataaacatcctcatgtcctcccttacagggaaaacttacaaaggttgcttgaagacagaagctttaaggaagagatagtgcattttagcatttcagaagataatgctgtagtgaaaacagcccaccgagcagatctatttcctattctgatgagaattttgtatgggcgaatgaagaataagactgggagtaaaactcaggggaaatctgcttcaggcacccgcatggccattgtcctgcggttcctggccgggacccaacctgaggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcagaaacgcaagatatttccctttgctggctaaacagaagcctgggcacccagaatgtgatatcctgaccaatgtttttgcaattctctcagcgaagaatctttctgatgccacagccagtattgtaatggacatagttgatgaccttcttaaccttccagatttcgagcctacagaaacagttttgaacttgctggtaactggatgtgtataccctggcatagcagaaaacatcggtgagtctatcacaataggaggaagattaattctacctcatgtacctgcaattcttcagtatctcagcaaaaccacaataagcgcagaaaaggtgaaaaagaaaaagaatagagcacaagtcagtaaagagcttggcattctttcaaagatcagcaagtttatgaaagacaaagaacaaagttctgtactcattacgcttctccttccattcctccaccgtggcaatattgctgaggatacagaggttgatattctggtgacagtacaaaacttgttaaagcattgtgtggaccctacaagcttcctcaagcctatagcaaaacttttctcagttattaagaacaaattgtcaagaaaattgctttgtacggtttttgagactctttctgattttgagagtgggttaaaatatattactgatgttgtcaagcttaacgccttcgatcaaagacatcttgatgatatcaacttcgacgttcgctttgagactttccagaccatcacctcttacattaaagaaatgcaaattgtggatgttaactacctaattccagttatgcataattgtttctataatctagagttaggagatatgagtttaagtgataatgccagcatgtgcctgatgagtatcatcaaaaagctagctgccttgaatgtcacagagaaagactatagagaaatcatccaccgttcactcctggagaaattgagaaaaggtctgaagagccagacagagagtattcagcaggattataccacaatactttcctgtttaattcaaacctttccaaaccaactggaattcaaagacttggtacaacttactcattaccatgacccagaaatggacttctttgagaacatgaagcacattcagatccacagaagagcaagagccttgaagaaacttgcaaaacaactaatggaaggcaaagttgttctgtcttctaaatctcttcagaattacatcatgccttatgccatgactccaatttttgatgagaaaatgctcaagcatgaaaatataaccactgctgccacagagattattggagccatttgcaaacatctctcttggtcagcgtatatgtattacttgaaacatttcattcatgtcttacaaacgggacagatcaatcaaaaactgggtgtcagtttgctagtaatagtgttagaagcattccactttgaccacaaaactcttgaagaacaaatgggaaaaattgagaatgaagaaaacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacgactaaaagggaagaagaacacaagcttgtcaagtcaaaggttgtgaatgatgaggaagtcgttcgagttccattagcttttgccatggttaaactaatgcagtcccttccacaagaagttatggaagctaatctgccaagtattttgctgaaagtgtgtgccctactcaagaacagagcccaagaaatcagagacattgcacgcagcactcttgcgaaaataatagaggatcttggtgtgcacttcctccaatatgttttaaaagaattacagactactcttgtccgtggataccaggtccatgtgctgactttcaccgttcacatgctgctgcaaggcctcaccaataagctgcaggtcggagatttggactcttgtttagatataatgattgagatttttaaccatgagttgtttggtgctgttgctgaagagaaggaagtaaagcagatcctctccaaagtcatggaagcacgaagaagcaaaagttacgactcttatgaaatcctcggcaagtttgtaggaaaagatcaggttacaaaactcatccttccattaaaagagatcttacaaaataccacgagtttgaaactggcccggaaagttcatgaaactttacgccgaatcacagtgggattaattgtaaatcaggaaatgacagctgaatccattctattactcagttatggtttgatcagtgaaaatcttcccctgttaacagagaaagaaaaaaatccagtagccccagcaccagatccacgtctaccaccccagagctgccttctgcttcccccaactccagttcgaggtggacagaaagctgttgtgagcaggaaaaccaacatgcacatatttattgagtccgggcttcggctgctgcatctgagtctgaagacttccaagatcaagtcttcaggtgaatgtgtcctggaaatgctggatccttttgtgtctctcctcatagactgcctgggctccatggatgtgaaggtgatcacaggtgctttacagtgcctcatctgggtcttgaggttcccgctaccttccatagaaacaaaagcagagcagctgacaaaacacctcttccttctgctgaaggactatgcaaagctcggggccgccaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatggttaccacttggtttggagcaaaaaagcgcttaaatagacaacttgctgccctgatctgtggcttgtttgtggaaagtgaaggagttgattttgagaaaagacttggaactgtccttcctgtgattgaaaaggaaattgatcctgaaaactttaaagatatcatggaagaaactgaagaaaaagctgcagatcgccttctgtttagttttcttacactgataactaaacttatcaaggaatgtaatattattcagtttaccaaacccgctgagactttgagtaaaatctggagtcatgtgcattctcacctgagacatccacacaactgggtgtggctcacagcagcccagatttttggattactctttgcctcttgccagccagaggagcttattcaaaaatggaataccaaaaagaccaaaaaacacctcccagaacctgtagcaatcaagttcctagccagtgaccttgaccaaaagatgaaaagtatctctctcgcctcttgccatcaattgcattccaaattcttggatcagtctctaggagaacaggttgttaagaatttgttgttcgcagccaaagtcttgtatttactggaactttattgtgaggataagcaaagtaagataaaagaagacctggaagaacaagaagctttagaagatggtgtggcctgtgcagatgagaaggcggagtctgacggagaagagaaggaagaggtgaaggaagagctcggcaggccggccacgctgctgtggttgatccagaagctgtcccggattgcaaaactggaagctgcttattcgccgagaaaccccttaaagagaacatgcatctttaagttcctcggcgccgtagcaatggatcttgggatagacaaggtaaagccgtatctcccaatgatcatagctcctttgtttcgggaactcaacagcacctattcagagcaagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggagtttgtaactaatcctgatattgctgccaagaaaaaaatgaagaaacacaaaaataaaagtgaagcaaagaagagaaagatagagttcctgcgtccaggatataaggccaagagacaaaaaagccatagcctgaaagatttagcaatggtggagtaatgtctccctgtgctgatacaagcatgaactttctggaatattctgctagtctgaaattacagcaggttgtctggggtaggggggaggcgtttttttttttttttgagacaaggtctcactctgtcacccaaggtggagtgcagtgacgacatcacagctcactgcagcctcaacctgggttcaagtgatcctctcacctcagcctcccaagtagttgtgcctcctaggcacacaacactatgcccggcaaattttttgtattttgtattttttgtagaaacaggatttcgccatgttggccaggctggtctcgaacacctgggctcaactgatccgcctgcctcggcctcccaaagtgctgggattacaggtgtgagccaccctgctcaaccaggttttattatttaagttagttaaactttggatagattgtataatatatagtttaatgtaatcatgctcatattttttaaataaataaaacactatactactgaaaag

SEQ ID NO: 426170 - DNA, 763 bp, Homo sapiens
agagttgtcatgtagagaggcatttaatttagaagttcaaagctcaagggaaaggtttgatctggagataacaaattggaaattatcaatatatggatggtattttaaatgatcagatacggaataaagtcatctagagtgtgactgtagagagaaaagactttcagggactgataccaatatttagaagttgggagataaggaaccagcaaaggaagccaggaaagagtgataaaagaagaaagaccacttgctatcctggaaatcaagtgaagagactaaaggcggcagtaaacagttgactcagatgtgtctgaaaagtccatcaggtgaggaataaagtgaccgttggctttggagtgaccttagtcagagtgacccacatgaaggtgaccttaatgagttgttttgattaatctgatagggatgacagcctaattaaaataagcttggctgggtgcagtggctcatgcctgtaatcccagcactttgggaggccgaggctggtggatcacaaggtcaggagatcgagaccatcctggctaacacggtgaaaccctgtctgtactaaaaatacaaaaaattagctaggcgtggtggtgggtgcctgtagtcccagctactcgggaggctgaggcaggagaatggcgtgaacccgggaggtggaggttgcagtgagccaaaattgtgtcactgcactccagcctgggcgacagagcgagactctgtctcaaaaaaaaaaaagaagctcaagaaagaggaa

SEQ ID NO: 426171 - DNA, 592 bp, Homo sapiens
agagttgtcatgtagagaggcatttaatttagaagttcaaagctcaagggaaaggtttgatctggagataacaaattggaaattatcaatatatggatggtattttaaatgatcagatacggaataaagtcatctagagtgtgactgtagagagaaaagactttcagggactgataccaatatttagaagttgggagataaggaaccagcaaaggaagccaggaaagagtgataaaagaagaaagaccacttgctatcctggaaatcaagtgaagagactaaaggcggcagtaaacagttgactcagatgtgtctgaaaagtccatcaggtgaggaataaagtgaccgttggctttggagtgaccttagtcagagtgacccacatgaaggtgaccttaatgagttgttttgattaatctgatagggatgacagcctaattaaaataagcttggctggacaggtgtgagccaccctgctcaaccaggttttattatttaagttagttaaactttggatagattgtataatatatagtttaatgtaatcatgctcatattttttaaataaataaaacactatactactgaaaag

SEQ ID NO: 426172 - DNA, 564 bp, Homo sapiens
aattcactcttttgtgtgacattccaagtgagaacacactattagagtagtttgaaatcattacaaatgtctgttcttttcacaattttttcctaagtatatttaaataacaatatatagaatagcaaatgagagttcttcatttggatatgtttatgtttgtgaatataattttccatttctactttatattttaggtctctgataaaaacgcacttttcaatttaatgtttcttgatcttgataaacatccagaaaaagttgaaggtgttggacagttgctctttgaaatgtgcaaaggagttagaaatatgtttcactcctgtacaggccaggcagtgaagctaattttgcgaaagctaggaccagtcactgaaacagaaactcaactaccatggatgttaattggagaaacactcaaaaacatggtcaaatccactgtatcctacatctccaaggaacattttggtacattttttgaatgtttgcaagtgagttctaatctttaaggatgggtttttgataaggagtctaagaatttactgtttctgctctcagttttgc

SEQ ID NO: 426173 - DNA, 402 bp, Homo sapiens
tgcgcctcagcttcctcatctaaaaactgctgatgatgtagtacctactccatagattggatgagtgaggcttaaatgatttaatacatgtaaggtattaatatagtacctaccctgtagtaagctctcagaaaacatcagcttgatttttgttgggtgcaaaaacttgtttccttcataatattttatttacaagctttgattacattcaacatgggcaagctccttaattcacaggttggtcttctttctttaaagttcaggactacaggtgtgagccaccctgctcaaccaggttttattatttaagttagttaaactttggatagattgtataatatatagtttaatgtaatcatgctcatattttttaaataaataaaacactatactactgaaaag

SEQ ID NO: 426174 - DNA, 4833 bp, Homo sapiens
tagacccaactggattagataccccatatcttagccctaacctcgacagttaaatcaacaaaactgctcgccagagatacagaggttgatattctggtgacagtacaaaacttgttaaagcattgtgtggaccctacaagcttcctcaagcctatagcaaaacttttctcagttattaagaacaaattgtcaagaaaattgctttgtacggtttttgagactctttctgattttgagagtgggttaaaatatattactgatgttgtcaagcttaacgccttcgatcaaagacatcttgatgatatcaacttcgacgttcgctttgagactttccagaccatcacctcttacattaaagaaatgcaaattgtggatgttaactacctaattccagttatgcataattgtttctataatctagagttaggagatatgagtttaagtgataatgccagcatgtgcctgatgagtatcatcaaaaagctagctgccttgaatgtcacagagaaagactatagagaaatcatccaccgttcactcctggagaaattgagaaaaggtctgaagagccagacagagagtattcagcaggattataccacaatactttcctgtttaattcaaacctttccaaaccaactggaattcaaagacttggtacaacttactcattaccatgacccagaaatggacttctttgagaacatgaagcacattcagatccacagaagagcaagagccttgaagaaacttgcaaaacaactaatggaaggcaaagttgttctgtcttctaaatctcttcagaattacatcatgccttatgccatgactccaatttttgatgagaaaatgctcaagcatgaaaatataaccactgctgccacagagattattggagccatttgcaaacatctctcttggtcagcgtatatgtattacttgaaacatttcattcatgtcttacaaacgggacagatcaatcaaaaactgggtgtcagtttgctagtaatagtgttagaagcattccactttgaccacaaaactcttgaagaacaaatgggaaaaattgagaatgaagaaaacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacgactaaaagggaagaagaacacaagcttgtcaagtcaaaggttgtgaatgatgaggaagtcgttcgagttccattagcttttgccatggttaaactaatgcagtcccttccacaagaagttatggaagctaatctgccaagtattttgctgaaagtgtgtgccctactcaagaacagagcccaagaaatcagagacattgcacgcagcactcttgcgaaaataatagaggatcttggtgtgcacttcctccaatatgttttaaaagaattacagactactcttgtccgtggataccaggtccatgtgctgactttcaccgttcacatgctgctgcaaggcctcaccaataagctgcaggtcggagatttggactcttgtttagatataatgattgagatttttaaccatgagttgtttggtgctgttgctgaagagaaggaagtaaagcagatcctctccaaagtcatggaagcacgaagaagcaaaagttacgactcttatgaaatcctcggcaagtttgtaggaaaagatcaggttacaaaactcatccttccattaaaagagatcttacaaaataccacgagtttgaaactggcccggaaagttcatgaaactttacgccgaatcacagtgggattaattgtaaatcaggaaatgacagctgaatccattctattactcagttatggtttgatcagtgaaaatcttcccctgttaacagagaaagaaaaaaatccagtagccccagcaccagatccacgtctaccaccccagagctgccttctgcttcccccaactccagttcgaggtggacagaaagctgttgtgagcaggaaaaccaacatgcacatatttattgagtccgggcttcggctgctgcatctgagtctgaagacttccaagatcaagtcttcaggtgaatgtgtcctggaaatgctggatccttttgtgtctctcctcatagactgcctgggctccatggatgtgaaggtgatcacaggtgctttacagtgcctcatctgggtcttgaggttcccgctaccttccatagaaacaaaagcagagcagctgacaaaacacctcttccttctgctgaaggactatgcaaagctcggggccgccaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatggttaccacttggtttggagcaaaaaagcgcttaaatagacaacttgctgccctgatctgtggcttgtttgtggaaagtgaaggagttgattttgagaaaagacttggaactgtccttcctgtgattgaaaaggaaattgatcctgaaaactttaaagatatcatggaagaaactgaagaaaaagctgcagatcgccttctgtttagttttcttacactgataactaaacttatcaaggaatgtaatattattcagtttaccaaacccgctgagactttgagtaaaatctggagtcatgtgcattctcacctgagacatccacacaactgggtgtggctcacagcagcccagatttttggattactctttgcctcttgccagccagaggagcttattcaaaaatggaataccaaaaagaccaaaaaacacctcccagaacctgtagcaatcaagttcctagccagtgaccttgaccaaaagatgaaaagtatctctctcgcctcttgccatcaattgcattccaaattcttggatcagtctctaggagaacaggttgttaagaatttgttgttcgcagccaaagtcttgtatttactggaactttattgtgaggataagcaaagtaagataaaagaagacctggaagaacaagaagctttagaagatggtgtggcctgtgcagatgagaaggcggagtctgacggagaagagaaggaagaggtgaaggaagagctcggcaggccggccacgctgctgtggttgatccagaagctgtcccggattgcaaaactggaagctgcttattcgccgagaaaccccttaaagagaacatgcatctttaagttcctcggcgccgtagcaatggatcttgggatagacaaggtaaagccgtatctcccaatgatcatagctcctttgtttcgggaactcaacagcacctattcagagcaagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggagtttgtaactaatcctgatattgctgccaagaaaaaaatgaagaaacacaaaaataaaagtgaagcaaagaagagaaagatagagttcctgcgtccaggatataaggccaagagacaaaaaagccatagcctgaaagatttagcaatggtggagtaatgtctccctgtgctgatacaagcatgaactttctggaatattctgctagtctgaaattacagcaggttgtctggggtaggggggaggcgtttttttttttttttgagacaaggtctcactctgtcacccaaggtggagtgcagtgacgacatcacagctcactgcagcctcaacctgggttcaagtgatcctctcacctcagcctcccaagtagttgtgcctcctaggcacacaacactatgcccggcaaattttttgtattttgtattttttgtagaaacaggatttcgccatgttggccaggctggtctcgaacacctgggctcaactgatccgcctgcctcggcctcccaaagtgctgggattacaggtgtgagccaccctgctcaaccaggttttattatttaagttagttaaactttggatagattgtataatatatagtttaatgtaatcatgctcatattttttaaataaataaaacactatactactgaaaag

SEQ ID NO: 426175 - DNA, 9232 bp, Homo sapiens
cccaggggctcaagccgcacgtgagaaagtctgggcatctgggattcggagagtatagcctgtgagccgctttcccctccttactgtcggttgcatcccttcgacactcccgaggccgtcgcgggccactggccctctgcagccatgaagacaaagcccgtttcccacaagaccgagaacacctaccggtttcttacatttgctgaacgactggggaatgttaatattgatattattcaccggattgatagaactgcaagctatgaggaggaggttgaaacctacttttttgagggtctgctgaaatggagagaattaaacctcacagaacacttcggaaaattttacaaagaagttattgacaaatgccaatcattcaatcagttggtgtatcaccaaaacgagatagttcagagtttgaagactcacctgcaagttaagaacagttttgcctatcaaccccttttggatttggttgtacagttggcacgagatctgcagatggatttctacccacactttccagagttttttttgactatcacctcgatcctggagactcaggacacagagttgttagaatgggctttcacctcgttatcatatctttataagtacctgtggagactgatggtgaaggacatgtccagtatatacagcatgtacagcacactcctggctcataaaaaactacatataagaaattttgctgctgaaagttttacttttttgatgagaaaggtctctgataaaaacgcacttttcaatttaatgtttcttgatcttgataaacatccagaaaaagttgaaggtgttggacagttgctctttgaaatgtgcaaaggagttagaaatatgtttcactcctgtacaggccaggcagtgaagctaattttgcgaaagctaggaccagtcactgaaacagaaactcaactaccatggatgttaattggagaaacactcaaaaacatggtcaaatccactgtatcctacatctccaaggaacattttggtacattttttgaatgtttgcaagaatcgctcttggatctacacacaaaagtaacaaaaactaactgttgtgaaagttctgaacagattaaaaggttgttggaaacataccttatacttgtaaaacatggaagtgggacaaagatacccacgcctgctgatgtctgtaaggtgttatctcaaacactgcaagtagccagtctctccacatcttgctgggagaccctcttggatgtaatttctgctttgatcctgggtgaaaatgtttccttgccggagaccctcatcaaagaaaccatagaaaaaatatttgagagcagatttgaaaaacgtttaattttcagtttttctgaagtcatgtttgccatgaagcagtttgagcagctttttctaccaagctttctgtcatatattgtgaattgcttcttaattgatgatgctgtagtcaaagatgaagctctggccattctggccaagctcattctgaacaaagcagcacctcccactgctggctcgatggcaattgaaaagtaccctctggttttctcaccgcagatggtgggattctatataaagcagaagaagactagatccaagggaagaaacgaacagtttccagtattggaccatcttttatctataattaagttacccccaaataaagatactacttacctttcacaatcttgggcagccctcgtggtgttacctcatattagacctcttgagaaagagaaggtgataccactcgtcaccggcttcatagaggcactcttcatgactgttgacaaaggaagctttgggaaaggaaacttatttgttctttgtcaagctgtaaatactctactaagtttggaagaatcttctgaacttcttcatttggttcctgtggaacgtgtgaagaatttagtattaacctttcccctggagccatctgtgttgctgttgactgatctctattatcagagattagccttgtgtggctgcaaagggccactttcccaggaggctttaatggaattatttcccaagttacaagcaaacatttcaactggtgtatccaagattcggcttttgacaataaggatcctaaaccattttgatgtccagcttccagaatcaatggaggatgatgggctctcagagcggcagtctgtctttgctatattacgccaggcagaacttgttccagcaactgtgaatgattatagagagaagcttcttcatttgagaaaactaagacatgatgtggtacagactgctgtccctgatgggccgttacaggaggtgccgcttcgttatttgttaggcatgctatatattaatttcagtgcactctgggatcctgttattgaactcataagttctcatgcacacgaaatggaaaataagcaattttggaaagtctactatgagcatctagaaaaagcagctacgcatgctgagaaggaactacagaatgatatgacagatgagaagtccgttggagatgaaagttgggagcagacccaggaaggagatgttggagctctttatcatgagcagttagcattgaaaactgactgtcaggaaagacttgaccacaccaacttcagattcctgctctggagagctctgaccaaattcccagaaagagtagagccacggtccagggagctttccccgcttttcttgagatttatcaacaatgagtattacccagcagatctgcaagttgctccaacccaggatctacggagaaaaggcaaagggatggtggcagaggaaatcgaagaggaacctgccgcaggagatgatgaagagttggaggaagaggcagtgccccaagatgaatcctcacagaagaaaaagacgaggagagctgcagcaaagcaattaattgctcatttgcaagttttctctaaattttcaaatccacgggccttatatctggaatccaaactatatgagttatatcttcagttgttgctacaccaagatcaaatggtgcaaaaaataaccttggattgcataatgacatataaacatcctcatgtcctcccttacagggaaaacttacaaaggttgcttgaagacagaagctttaaggaagagatagtgcattttagcatttcagaagataatgctgtagtgaaaacagcccaccgagcagatctatttcctattctgatgagaattttgtatgggcgaatgaagaataagactgggagtaaaactcaggggaaatctgcttcaggcacccgcatggccattgtcctgcggttcctggccgggacccaacctgaggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcagaaacgcaagatatttccctttgctggctaaacagaagcctgggcacccagaatgtgatatcctgaccaatgtttttgcaattctctcagcgaagaatctttctgatgccacagccagtattgtaatggacatagttgatgaccttcttaaccttccagatttcgagcctacagaaacagttttgaacttgctggtaactggatgtgtataccctggcatagcagaaaacatcggtgagtctatcacaataggaggaagattaattctacctcatgtacctgcaattcttcagtatctcagcaaaaccacaataagcgcagaaaaggtgaaaaagaaaaagaatagagcacaagtcagtaaagagcttggcattctttcaaagatcagcaagtttatgaaagacaaagaacaaagttctgtactcattacgcttctccttccattcctccaccgtggcaatattgctgaggatacagaggttgatattctggtgacagtacaaaacttgttaaagcattgtgtggaccctacaagcttcctcaagcctatagcaaaacttttctcagttattaagaacaaattgtcaagaaaattgctttgtacggtttttgagactctttctgattttgagagtgggttaaaatatattactgatgttgtcaagcttaacgccttcgatcaaagacatcttgatgatatcaacttcgacgttcgctttgagactttccagaccatcacctcttacattaaagaaatgcaaattgtggatgttaactacctaattccagttatgcataattgtttctataatctagagttaggagatatgagtttaagtgataatgccagcatgtgcctgatgagtatcatcaaaaagctagctgccttgaatgtcacagagaaagactatagagaaatcatccaccgttcactcctggagaaattgagaaaaggtctgaagagccagacagagagtattcagcaggattataccacaatactttcctgtttaattcaaacctttccaaaccaactggaattcaaagacttggtacaacttactcattaccatgacccagaaatggacttctttgagaacatgaagcacattcagatccacagaagagcaagagccttgaagaaacttgcaaaacaactaatggaaggcaaagttgttctgtcttctaaatctcttcagaattacatcatgccttatgccatgactccaatttttgatgagaaaatgctcaagcatgaaaatataaccactgctgccacagagattattggagccatttgcaaacatctctcttggtcagcgtatatgtattacttgaaacatttcattcatgtcttacaaacgggacagatcaatcaaaaactgggtgtcagtttgctagtaatagtgttagaagcattccactttgaccacaaaactcttgaagaacaaatgggaaaaattgagaatgaagaaaacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacgactaaaagggaagaagaacacaagcttgtcaagtcaaaggttgtgaatgatgaggaagtcgttcgagttccattagcttttgccatggttaaactaatgcagtcccttccacaagaagttatggaagctaatctgccaagtattttgctgaaagtgtgtgccctactcaagaacagagcccaagaaatcagagacattgcacgcagcactcttgcgaaaataatagaggatcttggtgtgcacttcctccaatatgttttaaaagaattacagactactcttgtccgtggataccaggtccatgtgctgactttcaccgttcacatgctgctgcaaggcctcaccaataagctgcaggtcggagatttggactcttgtttagatataatgattgagatttttaaccatgagttgtttggtgctgttgctgaagagaaggaagtaaagcagatcctctccaaagtcatggaagcacgaagaagcaaaagttacgactcttatgaaatcctcggcaagtttgtaggaaaagatcaggttacaaaactcatccttccattaaaagagatcttacaaaataccacgagtttgaaactggcccggaaagttcatgaaactttacgccgaatcacagtgggattaattgtaaatcaggaaatgacagctgaatccattctattactcagttatggtttgatcagtgaaaatcttcccctgttaacagagaaagaaaaaaatccagtagccccagcaccagatccacgtctaccaccccagagctgccttctgcttcccccaactccagttcgaggtggacagaaagctgttgtgagcaggaaaaccaacatgcacatatttattgagtccgggcttcggctgctgcatctgagtctgaagacttccaagatcaagtcttcaggtgaatgtgtcctggaaatgctggatccttttgtgtctctcctcatagactgcctgggctccatggatgtgaaggtgatcacaggtgctttacagtgcctcatctgggtcttgaggttcccgctaccttccatagaaacaaaagcagagcagctgacaaaacacctcttccttctgctgaaggactatgcaaagctcggggccgccaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatggttaccacttggtttggagcaaaaaagcgcttaaatagacaacttgctgccctgatctgtggcttgtttgtggaaagtgaaggagttgattttgagaaaagacttggaactgtccttcctgtgattgaaaaggaaattgatcctgaaaactttaaagatatcatggaagaaactgaagaaaaagctgcagatcgccttctgtttagttttcttacactgataactaaacttatcaaggaatgtaatattattcagtttaccaaacccgctgagactttgagtaaaatctggagtcatgtgcattctcacctgagacatccacacaactgggtgtggctcacagcagcccagatttttggattactctttgcctcttgccagccagaggagcttattcaaaaatggaataccaaaaagaccaaaaaacacctcccagaacctgtagcaatcaagttcctagccagtgaccttgaccaaaagatgaaaagtatctctctcgcctcttgccatcaattgcattccaaattcttggatcagtctctaggagaacaggttgttaagaatttgttgttcgcagccaaagtcttgtatttactggaactttattgtgaggataagcaaagtaagataaaagaagacctggaagaacaagaagctttagaagatggtgtggcctgtgcagatgagaaggcggagtctgacggagaagagaaggaagaggtgaaggaagagctcggcaggccggccacgctgctgtggttgatccagaagctgtcccggattgcaaaactggaagctgcttattcgccgagaaaccccttaaaggtgcgatgaatgcacagaatgactgacagtagtcatttctctttaaaaagtattttaatgatattagtgatcctcctaagtccctagaaactttatctttgaaccccaaactgcagcaataacatccgtcccaaaatagactgagccctgttttctcaattaatgctgtgtctatgattgagtgctaaagagaagtctttcaaatgaaaaaaatgatctgtactttcagagaacatgcatctttaagttcctcggcgccgtagcaatggatcttgggatagacaaggtaaagccgtatctcccaatgatcatagctcctttgtttcgggaactcaacagcacctattcagagcaagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggagtttgtaactaatcctgatattgctgccaagaaaaaaatgaagaaacacaaaaataaaagtgaagcaaagaagagaaagatagagttcctgcgtccaggatataaggccaagagacaaaaaagccatagcctgaaagatttagcaatggtggagtaatgtctccctgtgctgatacaagcatgaactttctggaatattctgctagtctgaaattacagcaggttgtctggggtaggggggaggcgtttttttttttttttgagacaaggtctcactctgtcacccaaggtggagtgcagtgacgacatcacagctcactgcagcctcaacctgggttcaagtgatcctctcacctcagcctcccaagtagttgtgcctcctaggcacacaacactatgcccggcaaattttttgtattttgtattttttgtagaaacaggatttcgccatgttggccaggctggtctcgaacacctgggctcaactgatccgcctgcctcggcctcccaaagtgctgggattacaggtgtgagccaccctgctcaaccaggttttattatttaagttagttaaactttggatagattgtataatatatagtttaatgtaatcatgctcatattttttaaataaataaaacactatactactgaaaag

SEQ ID NO: 426176 - DNA, 8482 bp, Homo sapiens
cccaggggctcaagccgcacgtgagaaagtctgggcatctgggattcggagagtatagcctgtgagccgctttcccctccttactgtcggttgcatcccttcgacactcccgaggccgtcgcgggccactggccctctgcagccatgaagacaaagcccgtttcccacaagaccgagaacacctaccggtttcttacatttgctgaacgactggggaatgttaatattgatattattcaccggattgatagaactgcaagctatgaggaggaggttgaaacctacttttttgagggtctgctgaaatggagagaattaaacctcacagaacacttcggaaaattttacaaagaagttattgacaaatgccaatcattcaatcagttggtgtatcaccaaaacgagatagttcagagtttgaagactcacctgcaagttaagaacagttttgcctatcaaccccttttggatttggttgtacagttggcacgagatctgcagatggatttctacccacactttccagagttttttttgactatcacctcgatcctggagactcaggacacagagttgttagaatgggctttcacctcgttatcatatctttataagtacctgtggagactgatggtgaaggacatgtccagtatatacagcatgtacagcacactcctggctcataaaaaactacatataagaaattttgctgctgaaagttttacttttttgatgagaaaggtctctgataaaaacgcacttttcaatttaatgtttcttgatcttgataaacatccagaaaaagttgaaggtgttggacagttgctctttgaaatgtgcaaaggagttagaaatatgtttcactcctgtacaggccaggcagtgaagctaattttgcgaaagctaggaccagtcactgaaacagaaactcaactaccatggatgttaattggagaaacactcaaaaacatggtcaaatccactgtatcctacatctccaaggaacattttggtacattttttgaatgtttgcaagaatcgctcttggatctacacacaaaagtaacaaaaactaactgttgtgaaagttctgaacagattaaaaggttgttggaaacataccttatacttgtaaaacatggaagtgggacaaagatacccacgcctgctgatgtctgtaaggtgttatctcaaacactgcaagtagccagtctctccacatcttgctgggagaccctcttggatgtaatttctgctttgatcctgggtgaaaatgtttccttgccggagaccctcatcaaagaaaccatagaaaaaatatttgagagcagatttgaaaaacgtttaattttcagtttttctgaagtcatgtttgccatgaagcagtttgagcagctttttctaccaagctttctgtcatatattgtgaattgcttcttaattgatgatgctgtagtcaaagatgaagctctggccattctggccaagctcattctgaacaaagcagcacctcccactgctggctcgatggcaattgaaaagtaccctctggttttctcaccgcagatggtgggattctatataaagcagaagaagactagatccaagggaagaaacgaacagtttccagtattggaccatcttttatctataattaagttacccccaaataaagatactacttacctttcacaatcttgggcagccctcgtggtgttacctcatattagacctcttgagaaagagaaggtgataccactcgtcaccggcttcatagaggcactcttcatgactgttgacaaaggaagctttgggaaaggaaacttatttgttctttgtcaagctgtaaatactctactaagtttggaagaatcttctgaacttcttcatttggttcctgtggaacgtgtgaagaatttagtattaacctttcccctggagccatctgtgttgctgttgactgatctctattatcagagattagccttgtgtggctgcaaagggccactttcccaggaggctttaatggaattatttcccaagttacaagcaaacatttcaactggtgtatccaagattcggcttttgacaataaggatcctaaaccattttgatgtccagcttccagaatcaatggaggatgatgggctctcagagcggcagtctgtctttgctatattacgccaggcagaacttgttccagcaactgtgaatgattatagagagaagcttcttcatttgagaaaactaagacatgatgtggtacagactgctgtccctgatgggccgttacaggaggtgccgcttcgttatttgttaggcatgctatatattaatttcagtgcactctgggatcctgttattgaactcataagttctcatgcacacgaaatggaaaataagcaattttggaaagtctactatgagcatctagaaaaagcagctacgcatgctgagaaggaactacagaatgatatgacagatgagaagtccgttggagatgaaagttgggagcagacccaggaaggagatgttggagctctttatcatgagcagttagcattgaaaactgactgtcaggaaagacttgaccacaccaacttcagattcctgctctggagagctctgaccaaattcccagaaagagtagagccacggtccagggagctttccccgcttttcttgagatttatcaacaatgagtattacccagcagatctgcaagttgctccaacccaggatctacggagaaaaggcaaagggatggtggcagaggaaatcgaagaggaacctgccgcaggagatgatgaagagttggaggaagaggcagtgccccaagatgaatcctcacagaagaaaaagacgaggagagctgcagcaaagcaattaattgctcatttgcaagttttctctaaattttcaaatccacgggccttatatctggaatccaaactatatgagttatatcttcagttgttgctacaccaagatcaaatggtgcaaaaaataaccttggattgcataatgacatataaacatcctcatgtcctcccttacagggaaaacttacaaaggttgcttgaagacagaagctttaaggaagagatagtgcattttagcatttcagaagataatgctgtagtgaaaacagcccaccgagcagatctatttcctattctgatgagaattttgtatgggcgaatgaagaataagactgggagtaaaactcaggggaaatctgcttcaggcacccgcatggccattgtcctgcggttcctggccgggacccaacctgaggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcagaaacgcaagatatttccctttgctggctaaacagaagcctgggcacccagaatgtgatatcctgaccaatgtttttgcaattctctcagcgaagaatctttctgatgccacagccagtattgtaatggacatagttgatgaccttcttaaccttccagatttcgagcctacagaaacagttttgaacttgctggtaactggatgtgtataccctggcatagcagaaaacatcggtgagtctatcacaataggaggaagattaattctacctcatgtacctgcaattcttcagtatctcagcaaaaccacaataagcgcagaaaaggtgaaaaagaaaaagaatagagcacaagtcagtaaagagcttggcattctttcaaagatcagcaagtttatgaaagacaaagaacaaagttctgtactcattacgcttctccttccattcctccaccgtggcaatattgctgaggatacagaggttgatattctggtgacagtacaaaacttgttaaagcattgtgtggaccctacaagcttcctcaagcctatagcaaaacttttctcagttattaagaacaaattgtcaagaaaattgctttgtacggtttttgagactctttctgattttgagagtgggttaaaatatattactgatgttgtcaagcttaacgccttcgatcaaagacatcttgatgatatcaacttcgacgttcgctttgagactttccagaccatcacctcttacattaaagaaatgcaaattgtggatgttaactacctaattccagttatgcataattgtttctataatctagagttaggagatatgagtttaagtgataatgccagcatgtgcctgatgagtatcatcaaaaagctagctgccttgaatgtcacagagaaagactatagagaaatcatccaccgttcactcctggagaaattgagaaaaggtctgaagagccagacagagagtattcagcaggattataccacaatactttcctgtttaattcaaacctttccaaaccaactggaattcaaagacttggtacaacttactcattaccatgacccagaaatggacttctttgagaacatgaagcacattcagatccacagaagagcaagagccttgaagaaacttgcaaaacaactaatggaaggcaaagttgttctgtcttctaaatctcttcagaattacatcatgccttatgccatgactccaatttttgatgagaaaatgctcaagcatgaaaatataaccactgctgccacagagattattggagccatttgcaaacatctctcttggtcagcgtatatgtattacttgaaacatttcattcatgtcttacaaacgggacagatcaatcaaaaactgggtgtcagtttgctagtaatagtgttagaagcattccactttgaccacaaaactcttgaagaacaaatgggaaaaattgagaatgaagaaaacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacgactaaaagggaagaagaacacaagcttgtcaagtcaaaggttgtgaatgatgaggaagtcgttcgagttccattagcttttgccatggttaaactaatgcagtcccttccacaagaagttatggaagctaatctgccaagtattttgctgaaagtgtgtgccctactcaagaacagagcccaagaaatcagagacattgcacgcagcactcttgcgaaaataatagaggatcttggtgtgcacttcctccaatatgttttaaaagaattacagactactcttgtccgtggataccaggtccatgtgctgactttcaccgttcacatgctgctgcaaggcctcaccaataagctgcaggtcggagatttggactcttgtttagatataatgattgagatttttaaccatgagttgtttggtgctgttgctgaagagaaggaagtaaagcagatcctctccaaagtcatggaagcacgaagaagcaaaagttacgactcttatgaaatcctcggcaagtttgtaggaaaagatcaggttacaaaactcatccttccattaaaagagatcttacaaaataccacgagtttgaaactggcccggaaagttcatgaaactttacgccgaatcacagtgggattaattgtaaatcaggaaatgacagctgaatccattctattactcagttatggtttgatcagtgaaaatcttcccctgttaacagagaaagaaaaaaatccagtagccccagcaccagatccacgtctaccaccccagagctgccttctgcttcccccaactccagttcgaggtggacagaaagctgttgtgagcaggaaaaccaacatgcacatatttattgagtccgggcttcggctgctgcatctgagtctgaagacttccaagatcaagtcttcaggtgaatgtgtcctggaaatgctggatccttttgtgtctctcctcatagactgcctgggctccatggatgtgaaggtgatcacaggtgctttacagtgcctcatctgggtcttgaggttcccgctaccttccatagaaacaaaagcagagcagctgacaaaacacctcttccttctgctgaaggactatgcaaagctcggggccgccaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatggttaccacttggtttggagcaaaaaagcgcttaaatagacaacttgctgccctgatctgtggcttgtttgtggaaagtgaaggagttgattttgagaaaagacttggaactgtccttcctgtgattgaaaaggaaattgatcctgaaaactttaaagatatcatggaagaaactgaagaaaaagctgcagatcgccttctgtttagttttcttacactgataactaaacttatcaaggaatgtaatattattcagtttaccaaacccgctgagactttgagtaaaatctggagtcatgtgcattctcacctgagacatccacacaactgggtgtggctcacagcagcccagatttttggattactctttgcctcttgccagccagaggagcttattcaaaaatggaataccaaaaagaccaaaaaacacctcccagaacctgtagcaatcaagttcctagccagtgaccttgaccaaaagatgaaaagtatctctctcgcctcttgccatcaattgcattccaaattcttggatcagtctctaggagaacaggttgttaagaatttgttgttcgcagccaaagtcttgtatttactggaactttattgtgaggataagcaaagtaagataaaagaagacctggaagaacaagaagctttagaagatggtgtggcctgtgcagatgagaaggcggagtctgacggagaagagaaggaagaggtgaaggaagagctcggcaggccggccacgctgctgtggttgatccagaagctgtcccggattgcaaaactggaagctgcttattcgccgagaaaccccttaaaggtgcgatgaatgcacagaatgactgacagtagtcatttctctttaaaaagtattttaatgatattagtgatcctcctaagtccctagaaactttatctttgaaccccaaactgcagcaataacatccgtcccaaaatagactgagccctgttttctcaattaatgctgtgtctatgattgagtgctaaagagaagtctttcaaatgaaaaaaatgatctgtactttcagagaacatgcatctttaagttcctcggcgccgtagcaatggatcttgggatagacaaggtaaagccgtatctcccaatgatcatagctcctttgtttcgggaactcaacagcacctattcagagcaaggtaaccctgcctcgtctgttctcctgccttttgcacatgaggatttctaactt

SEQ ID NO: 426177 - DNA, 7757 bp, Homo sapiens
  misc_feature (7659)..(7659): n is a, c, g, or t
cccaggggctcaagccgcacgtgagaaagtctgggcatctgggattcggagagtatagcctgtgagccgctttcccctccttactgtcggttgcatcccttcgacactcccgaggccgtcgcgggccactggccctctgcagccatgaagacaaagcccgtttcccacaagaccgagaacacctaccggtttcttacatttgctgaacgactggggaatgttaatattgatattattcaccggattgatagaactgcaagctatgaggaggaggttgaaacctacttttttgagggtctgctgaaatggagagaattaaacctcacagaacacttcggaaaattttacaaagaagttattgacaaatgccaatcattcaatcagttggtgtatcaccaaaacgagatagttcagagtttgaagactcacctgcaagttaagaacagttttgcctatcaaccccttttggatttggttgtacagttggcacgagatctgcagatggatttctacccacactttccagagttttttttgactatcacctcgatcctggagactcaggacacagagttgttagaatgggctttcacctcgttatcatatctttataagtacctgtggagactgatggtgaaggacatgtccagtatatacagcatgtacagcacactcctggctcataaaaaactacatataagaaattttgctgctgaaagttttacttttttgatgagaaaggtctctgataaaaacgcacttttcaatttaatgtttcttgatcttgataaacatccagaaaaagttgaaggtgttggacagttgctctttgaaatgtgcaaaggagttagaaatatgtttcactcctgtacaggccaggcagtgaagctaattttgcgaaagctaggaccagtcactgaaacagaaactcaactaccatggatgttaattggagaaacactcaaaaacatggtcaaatccactgtatcctacatctccaaggaacattttggtacattttttgaatgtttgcaagaatcgctcttggatctacacacaaaagtaacaaaaactaactgttgtgaaagttctgaacagattaaaaggttgttggaaacataccttatacttgtaaaacatggaagtgggacaaagatacccacgcctgctgatgtctgtaaggtgttatctcaaacactgcaagtagccagtctctccacatcttgctgggagaccctcttggatgtaatttctgctttgatcctgggtgaaaatgtttccttgccggagaccctcatcaaagaaaccatagaaaaaatatttgagagcagatttgaaaaacgtttaattttcagtttttctgaagtcatgtttgccatgaagcagtttgagcagctttttctaccaagctttctgtcatatattgtgaattgcttcttaattgatgatgctgtagtcaaagatgaagctctggccattctggccaagctcattctgaacaaagcagcacctcccactgctggctcgatggcaattgaaaagtaccctctggttttctcaccgcagatggtgggattctatataaagcagaagaagactagatccaagggaagaaacgaacagtttccagtattggaccatcttttatctataattaagttacccccaaataaagatactacttacctttcacaatcttgggcagccctcgtggtgttacctcatattagacctcttgagaaagagaaggtgataccactcgtcaccggcttcatagaggcactcttcatgactgttgacaaaggaagctttgggaaaggaaacttatttgttctttgtcaagctgtaaatactctactaagtttggaagaatcttctgaacttcttcatttggttcctgtggaacgtgtgaagaatttagtattaacctttcccctggagccatctgtgttgctgttgactgatctctattatcagagattagccttgtgtggctgcaaagggccactttcccaggaggctttaatggaattatttcccaagttacaagcaaacatttcaactggtgtatccaagattcggcttttgacaataaggatcctaaaccattttgatgtccagcttccagaatcaatggaggatgatgggctctcagagcggcagtctgtctttgctatattacgccaggcagaacttgttccagcaactgtgaatgattatagagagaagcttcttcatttgagaaaactaagacatgatgtggtacagactgctgtccctgatgggccgttacaggaggtgccgcttcgttatttgttaggcatgctatatattaatttcagtgcactctgggatcctgttattgaactcataagttctcatgcacacgaaatggaaaataagcaattttggaaagtctactatgagcatctagaaaaagcagctacgcatgctgagaaggaactacagaatgatatgacagatgagaagtccgttggagatgaaagttgggagcagacccaggaaggagatgttggagctctttatcatgagcagttagcattgaaaactgactgtcaggaaagacttgaccacaccaacttcagattcctgctctggagagctctgaccaaattcccagaaagagtagagccacggtccagggagctttccccgcttttcttgagatttatcaacaatgagtattacccagcagatctgcaagttgctccaacccaggatctacggagaaaaggcaaagggatggtggcagaggaaatcgaagaggaacctgccgcaggagatgatgaagagttggaggaagaggcagtgccccaagatgaatcctcacagaagaaaaagacgaggagagctgcagcaaagcaattaattgctcatttgcaagttttctctaaattttcaaatccacgggccttatatctggaatccaaactatatgagttatatcttcagttgttgctacaccaagatcaaatggtgcaaaaaataaccttggattgcataatgacatataaacatcctcatgtcctcccttacagggaaaacttacaaaggttgcttgaagacagaagctttaaggaagagatagtgcattttagcatttcagaagataatgctgtagtgaaaacagcccaccgagcagatctatttcctattctgatgagaattttgtatgggcgaatgaagaataagactgggagtaaaactcaggggaaatctgcttcaggcacccgcatggccattgtcctgcggttcctggccgggacccaacctgaggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcagaaacgcaagatatttccctttgctggctaaacagaagcctgggcacccagaatgtgatatcctgaccaatgtttttgcaattctctcagcgaagaatctttctgatgccacagccagtattgtaatggacatagttgatgaccttcttaaccttccagatttcgagcctacagaaacagttttgaacttgctggtaactggatgtgtataccctggcatagcagaaaacatcggtgagtctatcacaataggaggaagattaattctacctcatgtacctgcaattcttcagtatctcagcaaaaccacaataagcgcagaaaaggtgaaaaagaaaaagaatagagcacaagtcagtaaagagcttggcattctttcaaagatcagcaagtttatgaaagacaaagaacaaagttctgtactcattacgcttctccttccattcctccaccgtggcaatattgctgaggatacagaggttgatattctggtgacagtacaaaacttgttaaagcattgtgtggaccctacaagcttcctcaagcctatagcaaaacttttctcagttattaagaacaaattgtcaagaaaattgctttgtacggtttttgagactctttctgattttgagagtgggttaaaatatattactgatgttgtcaagcttaacgccttcgatcaaagacatcttgatgatatcaacttcgacgttcgctttgagactttccagaccatcacctcttacattaaagaaatgcaaattgtggatgttaactacctaattccagttatgcataattgtttctataatctagagttaggagatatgagtttaagtgataatgccagcatgtgcctgatgagtatcatcaaaaagctagctgccttgaatgtcacagagaaagactatagagaaatcatccaccgttcactcctggagaaattgagaaaaggtctgaagagccagacagagagtattcagcaggattataccacaatactttcctgtttaattcaaacctttccaaaccaactggaattcaaagacttggtacaacttactcattaccatgacccagaaatggacttctttgagaacatgaagcacattcagatccacagaagagcaagagccttgaagaaacttgcaaaacaactaatggaaggcaaagttgttctgtcttctaaatctcttcagaattacatcatgccttatgccatgactccaatttttgatgagaaaatgctcaagcatgaaaatataaccactgctgccacagagattattggagccatttgcaaacatctctcttggtcagcgtatatgtattacttgaaacatttcattcatgtcttacaaacgggacagatcaatcaaaaactgggtgtcagtttgctagtaatagtgttagaagcattccactttgaccacaaaactcttgaagaacaaatgggaaaaattgagaatgaagaaaacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacgactaaaagggaagaagaacacaagcttgtcaagtcaaaggttgtgaatgatgaggaagtcgttcgagttccattagcttttgccatggttaaactaatgcagtcccttccacaagaagttatggaagctaatctgccaagtattttgctgaaagtgtgtgccctactcaagaacagagcccaagaaatcagagacattgcacgcagcactcttgcgaaaataatagaggatcttggtgtgcacttcctccaatatgttttaaaagaattacagactactcttgtccgtggataccaggtccatgtgctgactttcaccgttcacatgctgctgcaaggcctcaccaataagctgcaggtcggagatttggactcttgtttagatataatgattgagatttttaaccatgagttgtttggtgctgttgctgaagagaaggaagtaaagcagatcctctccaaagtcatggaagcacgaagaagcaaaagttacgactcttatgaaatcctcggcaagtttgtaggaaaagatcaggttacaaaactcatccttccattaaaagagatcttacaaaataccacgagtttgaaactggcccggaaagttcatgaaactttacgccgaatcacagtgggattaattgtaaatcaggaaatgacagctgaatccattctattactcagttatggtttgatcagtgaaaatcttcccctgttaacagagaaagaaaaaaatccagtagccccagcaccagatccacgtctaccaccccagagctgccttctgcttcccccaactccagttcgaggtggacagaaagctgttgtgagcaggaaaaccaacatgcacatatttattgagtccgggcttcggctgctgcatctgagtctgaagacttccaagatcaagtcttcaggtgaatgtgtcctggaaatgctggatccttttgtgtctctcctcatagactgcctgggctccatggatgtgaaggtgatcacaggtgctttacagtgcctcatctgggtcttgaggttcccgctaccttccatagaaacaaaagcagagcagctgacaaaacacctcttccttctgctgaaggactatgcaaagctcggggccgccaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatggttaccacttggtttggagcaaaaaaggtgtgcgttgcttttagtcacagttcagtgacaagtcttagctttggggatcatagtttaagtaagaatatatgtcatacactgttgaattggtttttttcccaaatagtgttatttttgtctgattatgcaaatagtatattcttaaagttttccaaagtgtaagaagttataaaaagtaatataggccgggttcaagtgattcttctgcctcagcctcctgagtagctgggactacaggcgtgtgccaccatgcccagctaatttttgtattttttagtagagacaggttttcaccgtgttggccaggatggtctccatctcttgacctcatgatccgcctgcctcggcctcccaaagtgctgggattacaggtgtgagccnccgtgcctggcctagatcattcttaagttcttcctcatagggcatcgaaacccatttccatgtaactttgatctatctgactagttctacctaactta

SEQ ID NO: 426178 - DNA, 925 bp, Homo sapiens
atttggggtttcttgccagatcagtagctggatataaatgttgtacatattgttgattttgttgatgttcaaatgtgtcctttcctacctgtctctgatcattactctttgtgtgtgattagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggagtttgtaactaatcctgatattgctgccaagaaaaaaatgaagaaacacaaaaataaaagtgaagcaaagaagagaaagatagagttcctgcgtccaggatataaggccaagagacaaaaaagccatagcctgaaagatttagcaatggtggagtaatgtctccctgtgctgatacaagcatgaactttctggaatattctgctagtctgaaattacagcaggttgtctggggtaggggggaggcgtttttttttttttttgagacaaggtctcactctgtcacccaaggtggagtgcagtgacgacatcacagctcactgcagcctcaacctgggttcaagtgatcctctcacctcagcctcccaagtagttgtgcctcctaggcacacaacactatgcccggcaaattttttgtattttgtattttttgtagaaacaggatttcgccatgttggccaggctggtctcgaacacctgggctcaactgatccgcctgcctcggcctcccaaagtgctgggattacaggtgtgagccaccctgctcaaccaggttttattatttaagttagttaaactttggatagattgtataatatatagtttaatgtaatcatgctcatattttttaaataaataaaacactatactactgaaaag

SEQ ID NO: 426179 - DNA, 1164 bp, Homo sapiens
atttggggtttcttgccagatcagtagctggatataaatgttgtacatattgttgattttgttgatgttcaaatgtgtcctttcctacctgtctctgatcattactctttgtgtgtgattagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggaggtaagtttgctctttgaaaatatggcatgttcactggacttgataactactaagtgtgcatgtttgtgtcacacttacacttagggaggatcaagggtttgagcggttggggactttatagctgggacttcagattttctttaatgagcatgtgttttttacatttatttctgtatttgattcttattggtttaacatttactttaaaagtaatataaaatttctattctcttttccagtttgtaactaatcctgatattgctgccaagaaaaaaatgaagaaacacaaaaataaaagtgaagcaaagaagagaaagatagagttcctgcgtccaggatataaggccaagagacaaaaaagccatagcctgaaagatttagcaatggtggagtaatgtctccctgtgctgatacaagcatgaactttctggaatattctgctagtctgaaattacagcaggttgtctggggtaggggggaggcgtttttttttttttttgagacaaggtctcactctgtcacccaaggtggagtgcagtgacgacatcacagctcactgcagcctcaacctgggttcaagtgatcctctcacctcagcctcccaagtagttgtgcctcctaggcacacaacactatgcccggcaaattttttgtattttgtattttttgtagaaacaggatttcgccatgttggccaggctggtctcgaacacctgggctcaactgatccgcctgcctcggcctcccaaagtgctgggattacaggtgtgagccaccctgctcaaccaggttttattatttaagttagttaaactttggatagattgtataatatatagtttaatgtaatcatgctcatattttttaaataaataaaacactatactactgaaaag

SEQ ID NO: 426180 - DNA, 378 bp, Homo sapiens
caaacaaataatgtgcttttgccttttcagaattttgtatgggcgaatgaagaataagactgggagtaaaactcaggggaaatctgcttcaggcacccgcatggccattgtcctgcggttcctggccgggacccaacctgaggagatccagatattcttagacctgctgtttgaacctgtgaggcatttcaagaatggtaactatcagctacctctcactctaatacctgttgtctgcggtggacttctcacatctcaggctacatttcccatgctcctgggcgtctttctaacagggttgttcctcccaatcttgatggcaatctttttgctgaagtgcaactcattttaaacttcaattaaattgcgtgaaactga

SEQ ID NO: 426181 - DNA, 498 bp, Homo sapiens
ctgggctctcgtcactttagaagggccactctaacttcttggaatgcagctgacagtgttctttaccctcttctcatgccacgtgattgacagaaatccagtagccccagcaccagatccacgtctaccaccccagagctgccttctgcttcccccaactccagttcgaggtggacagaaagctgttgtgagcaggaaaaccaacatgcacatatttattgagtccgggcttcgggtaagaattaaccttaaaatgagacttgctactttcagggagtctgcaccttttagtcttctgttgaatttctagtactgctcacttccattggaaatgccttactgtaaatacattttagattttttttttttacaggtgcattggtccatttactatttatctcttgcagcacttacattgaagatgtaactgtcccagaattaatgattctgctctaatatgtattaaggtcttactgatgctttgcccatgagtccctc

SEQ ID NO: 426182 - DNA, 6044 bp, Homo sapiens
ctgggactacaggcacgtagcactgcacccagctctcttagccttattttgttgttgacttttttcattgtctgtgttaaatatctaatttctattttcatgtttctgtgttttataatatatccatttaaatctattgagttgctcttctagccttttaggcaaataaaacaactcatattttagaattaatgtgcaaacaaataatgtgcttttgccttttcagaattttgtatgggcgaatgaagaataagactgggagtaaaactcaggggaaatctgcttcaggcacccgcatggccattgtcctgcggttcctggccgggacccaacctgaggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcagaaacgcaagatatttccctttgctggctaaacagaagcctgggcacccagaatgtgatatcctgaccaatgtttttgcaattctctcagcgaagaatctttctgatgccacagccagtattgtaatggacatagttgatgaccttcttaaccttccagatttcgagcctacagaaacagttttgaacttgctggtaactggatgtgtataccctggcatagcagaaaacatcggtgagtctatcacaataggaggaagattaattctacctcatgtacctgcaattcttcagtatctcagcaaaaccacaataagcgcagaaaaggtgaaaaagaaaaagaatagagcacaagtcagtaaagagcttggcattctttcaaagatcagcaagtttatgaaagacaaagaacaaagttctgtactcattacgcttctccttccattcctccaccgtggcaatattgctgaggatacagaggttgatattctggtgacagtacaaaacttgttaaagcattgtgtggaccctacaagcttcctcaagcctatagcaaaacttttctcagttattaagaacaaattgtcaagaaaattgctttgtacggtttttgagactctttctgattttgagagtgggttaaaatatattactgatgttgtcaagcttaacgccttcgatcaaagacatcttgatgatatcaacttcgacgttcgctttgagactttccagaccatcacctcttacattaaagaaatgcaaattgtggatgttaactacctaattccagttatgcataattgtttctataatctagagttaggagatatgagtttaagtgataatgccagcatgtgcctgatgagtatcatcaaaaagctagctgccttgaatgtcacagagaaagactatagagaaatcatccaccgttcactcctggagaaattgagaaaaggtctgaagagccagacagagagtattcagcaggattataccacaatactttcctgtttaattcaaacctttccaaaccaactggaattcaaagacttggtacaacttactcattaccatgacccagaaatggacttctttgagaacatgaagcacattcagatccacagaagagcaagagccttgaagaaacttgcaaaacaactaatggaaggcaaagttgttctgtcttctaaatctcttcagaattacatcatgccttatgccatgactccaatttttgatgagaaaatgctcaagcatgaaaatataaccactgctgccacagagattattggagccatttgcaaacatctctcttggtcagcgtatatgtattacttgaaacatttcattcatgtcttacaaacgggacagatcaatcaaaaactgggtgtcagtttgctagtaatagtgttagaagcattccactttgaccacaaaactcttgaagaacaaatgggaaaaattgagaatgaagaaaacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacgactaaaagggaagaagaacacaagcttgtcaagtcaaaggttgtgaatgatgaggaagtcgttcgagttccattagcttttgccatggttaaactaatgcagtcccttccacaagaagttatggaagctaatctgccaagtattttgctgaaagtgtgtgccctactcaagaacagagcccaagaaatcagagacattgcacgcagcactcttgcgaaaataatagaggatcttggtgtgcacttcctccaatatgttttaaaagaattacagactactcttgtccgtggataccaggtccatgtgctgactttcaccgttcacatgctgctgcaaggcctcaccaataagctgcaggtcggagatttggactcttgtttagatataatgattgagatttttaaccatgagttgtttggtgctgttgctgaagagaaggaagtaaagcagatcctctccaaagtcatggaagcacgaagaagcaaaagttacgactcttatgaaatcctcggcaagtttgtaggaaaagatcaggttacaaaactcatccttccattaaaagagatcttacaaaataccacgagtttgaaactggcccggaaagttcatgaaactttacgccgaatcacagtgggattaattgtaaatcaggaaatgacagctgaatccattctattactcagttatggtttgatcagtgaaaatcttcccctgttaacagagaaagaaaaaaatccagtagccccagcaccagatccacgtctaccaccccagagctgccttctgcttcccccaactccagttcgaggtggacagaaagctgttgtgagcaggaaaaccaacatgcacatatttattgagtccgggcttcggctgctgcatctgagtctgaagacttccaagatcaagtcttcaggtgaatgtgtcctggaaatgctggatccttttgtgtctctcctcatagactgcctgggctccatggatgtgaaggtgatcacaggtgctttacagtgcctcatctgggtcttgaggttcccgctaccttccatagaaacaaaagcagagcagctgacaaaacacctcttccttctgctgaaggactatgcaaagctcggggccgccaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatggttaccacttggtttggagcaaaaaagcgcttaaatagacaacttgctgccctgatctgtggcttgtttgtggaaagtgaaggagttgattttgagaaaagacttggaactgtccttcctgtgattgaaaaggaaattgatcctgaaaactttaaagatatcatggaagaaactgaagaaaaagctgcagatcgccttctgtttagttttcttacactgataactaaacttatcaaggaatgtaatattattcagtttaccaaacccgctgagactttgagtaaaatctggagtcatgtgcattctcacctgagacatccacacaactgggtgtggctcacagcagcccagatttttggattactctttgcctcttgccagccagaggagcttattcaaaaatggaataccaaaaagaccaaaaaacacctcccagaacctgtagcaatcaagttcctagccagtgaccttgaccaaaagatgaaaagtatctctctcgcctcttgccatcaattgcattccaaattcttggatcagtctctaggagaacaggttgttaagaatttgttgttcgcagccaaagtcttgtatttactggaactttattgtgaggataagcaaagtaagataaaagaagacctggaagaacaagaagctttagaagatggtgtggcctgtgcagatgagaaggcggagtctgacggagaagagaaggaagaggtgaaggaagagctcggcaggccggccacgctgctgtggttgatccagaagctgtcccggattgcaaaactggaagctgcttattcgccgagaaaccccttaaagagaacatgcatctttaagttcctcggcgccgtagcaatggatcttgggatagacaaggtaaagccgtatctcccaatgatcatagctcctttgtttcgggaactcaacagcacctattcagagcaagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggagtttgtaactaatcctgatattgctgccaagaaaaaaatgaagaaacacaaaaataaaagtgaagcaaagaagagaaagatagagttcctgcgtccaggatataaggccaagagacaaaaaagccatagcctgaaagatttagcaatggtggagtaatgtctccctgtgctgatacaagcatgaactttctggaatattctgctagtctgaaattacagcaggttgtctggggtaggggggaggcgtttttttttttttttgagacaaggtctcactctgtcacccaaggtggagtgcagtgacgacatcacagctcactgcagcctcaacctgggttcaagtgatcctctcacctcagcctcccaagtagttgtgcctcctaggcacacaacactatgcccggcaaattttttgtattttgtattttttgtagaaacaggatttcgccatgttggccaggctggtctcgaacacctgggctcaactgatccgcctgcctcggcctcccaaagtgctgggattacaggtgtgagccaccctgctcaaccaggttttattatttaagttagttaaactttggatagattgtataatatatagtttaatgtaatcatgctcatattttttaaataaataaaacactatactactgaaaag

SEQ ID NO: 426183 - DNA, 8422 bp, Homo sapiens
cccaggggctcaagccgcacgtgagaaagtctgggcatctgggattcggagagtatagcctgtgagccgctttcccctccttactgtcggttgcatcccttcgacactcccgaggccgtcgcgggccactggccctctgcagccatgaagacaaagcccgtttcccacaagaccgagaacacctaccggtttcttacatttgctgaacgactggggaatgttaatattgatattattcaccggattgatagaactgcaagctatgaggaggaggttgaaacctacttttttgagggtctgctgaaatggagagaattaaacctcacagaacacttcggaaaattttacaaagaagttattgacaaatgccaatcattcaatcagttggtgtatcaccaaaacgagatagttcagagtttgaagactcacctgcaagttaagaacagttttgcctatcaaccccttttggatttggttgtacagttggcacgagatctgcagatggatttctacccacactttccagagttttttttgactatcacctcgatcctggagactcaggacacagagttgttagaatgggctttcacctcgttatcatatctttataagtacctgtggagactgatggtgaaggacatgtccagtatatacagcatgtacagcacactcctggctcataaaaaactacatataagaaattttgctgctgaaagttttacttttttgatgagaaaggtctctgataaaaacgcacttttcaatttaatgtttcttgatcttgataaacatccagaaaaagttgaaggtgttggacagttgctctttgaaatgtgcaaaggagttagaaatatgtttcactcctgtacaggccaggcagtgaagctaattttgcgaaagctaggaccagtcactgaaacagaaactcaactaccatggatgttaattggagaaacactcaaaaacatggtcaaatccactgtatcctacatctccaaggaacattttggtacattttttgaatgtttgcaagaatcgctcttggatctacacacaaaagtaacaaaaactaactgttgtgaaagttctgaacagattaaaaggttgttggaaacataccttatacttgtaaaacatggaagtgggacaaagatacccacgcctgctgatgtctgtaaggtgttatctcaaacactgcaagtagccagtctctccacatcttgctgggagaccctcttggatgtaatttctgctttgatcctgggtgaaaatgtttccttgccggagaccctcatcaaagaaaccatagaaaaaatatttgagagcagatttgaaaaacgtttaattttcagtttttctgaagtcatgtttgccatgaagcagtttgagcagctttttctaccaagctttctgtcatatattgtgaattgcttcttaattgatgatgctgtagtcaaagatgaagctctggccattctggccaagctcattctgaacaaagcagcacctcccactgctggctcgatggcaattgaaaagtaccctctggttttctcaccgcagatggtgggattctatataaagcagaagaagactagatccaagggaagaaacgaacagtttccagtattggaccatcttttatctataattaagttacccccaaataaagatactacttacctttcacaatcttgggcagccctcgtggtgttacctcatattagacctcttgagaaagagaaggtgataccactcgtcaccggcttcatagaggcactcttcatgactgttgacaaaggaagctttgggaaaggaaacttatttgttctttgtcaagctgtaaatactctactaagtttggaagaatcttctgaacttcttcatttggttcctgtggaacgtgtgaagaatttagtattaacctttcccctggagccatctgtgttgctgttgactgatctctattatcagagattagccttgtgtggctgcaaagggccactttcccaggaggctttaatggaattatttcccaagttacaagcaaacatttcaactggtgtatccaagattcggcttttgacaataaggatcctaaaccattttgatgtccagcttccagaatcaatggaggatgatgggctctcagagcggcagtctgtctttgctatattacgccaggcagaacttgttccagcaactgtgaatgattatagagagaagcttcttcatttgagaaaactaagacatgatgtggtacagactgctgtccctgatgggccgttacaggaggtgccgcttcgttatttgttaggcatgctatatattaatttcagtgcactctgggatcctgttattgaactcataagttctcatgcacacgaaatggaaaataagcaattttggaaagtctactatgagcatctagaaaaagcagctacgcatgctgagaaggaactacagaatgatatgacagatgagaagtccgttggagatgaaagttgggagcagacccaggaaggagatgttggagctctttatcatgagcagttagcattgaaaactgactgtcaggaaagacttgaccacaccaacttcagattcctgctctggagagctctgaccaaattcccagaaagagtagagccacggtccagggagctttccccgcttttcttgagatttatcaacaatgagtattacccagcagatctgcaagttgctccaacccaggatctacggagaaaaggcaaagggatggtggcagaggaaatcgaagaggaacctgccgcaggagatgatgaagagttggaggaagaggcagtgccccaagatgaatcctcacagaagaaaaagacgaggagagctgcagcaaagcaattaattgctcatttgcaagttttctctaaattttcaaatccacgggccttatatctggaatccaaactatatgagttatatcttcagttgttgctacaccaagatcaaatggtgcaaaaaataaccttggattgcataatgacatataaacatcctcatgtcctcccttacagggaaaacttacaaaggttgcttgaagacagaagctttaaggaagagatagtgcattttagcatttcagaagataatgctgtagtgaaaacagcccaccgagcagatctatttcctattctgatgagaattttgtatgggcgaatgaagaataagactgggagtaaaactcaggggaaatctgcttcaggcacccgcatggccattgtcctgcggttcctggccgggacccaacctgaggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcagaaacgcaagatatttccctttgctggctaaacagaagcctgggcacccagaatgtgatatcctgaccaatgtttttgcaattctctcagcgaagaatctttctgatgccacagccagtattgtaatggacatagttgatgaccttcttaaccttccagatttcgagcctacagaaacagttttgaacttgctggtaactggatgtgtataccctggcatagcagaaaacatcggtgagtctatcacaataggaggaagattaattctacctcatgtacctgcaattcttcagtatctcagcaaaaccacaataagcgcagaaaaggtgaaaaagaaaaagaatagagcacaagtcagtaaagagcttggcattctttcaaagatcagcaagtttatgaaagacaaagaacaaagttctgtactcattacgcttctccttccattcctccaccgtggcaatattgctgaggatacagaggttgatattctggtgacagtacaaaacttgttaaagcattgtgtggaccctacaagcttcctcaagcctatagcaaaacttttctcagttattaagaacaaattgtcaagaaaattgctttgtacggtttttgagactctttctgattttgagagtgggttaaaatatattactgatgttgtcaagcttaacgccttcgatcaaagacatcttgatgatatcaacttcgacgttcgctttgagactttccagaccatcacctcttacattaaagaaatgcaaattgtggatgttaactacctaattccagttatgcataattgtttctataatctagagttaggagatatgagtttaagtgataatgccagcatgtgcctgatgagtatcatcaaaaagctagctgccttgaatgtcacagagaaagactatagagaaatcatccaccgttcactcctggagaaattgagaaaaggtctgaagagccagacagagagtattcagcaggattataccacaatactttcctgtttaattcaaacctttccaaaccaactggaattcaaagacttggtacaacttactcattaccatgacccagaaatggacttctttgagaacatgaagcacattcagatccacagaagagcaagagccttgaagaaacttgcaaaacaactaatggaaggcaaagttgttctgtcttctaaatctcttcagaattacatcatgccttatgccatgactccaatttttgatgagaaaatgctcaagcatgaaaatataaccactgctgccacagagattattggagccatttgcaaacatctctcttggtcagcgtatatgtattacttgaaacatttcattcatgtcttacaaacgggacagatcaatcaaaaactgggtgtcagtttgctagtaatagtgttagaagcattccactttgaccacaaaactcttgaagaacaaatgggaaaaattgagaatgaagaaaacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacgactaaaagggaagaagaacacaagcttgtcaagtcaaaggttgtgaatgatgaggaagtcgttcgagttccattagcttttgccatggttaaactaatgcagtcccttccacaagaagttatggaagctaatctgccaagtattttgctgaaagtgtgtgccctactcaagaacagagcccaagaaatcagagacattgcacgcagcactcttgcgaaaataatagaggatcttggtgtgcacttcctccaatatgttttaaaagaattacagactactcttgtccgtggataccaggtccatgtgctgactttcaccgttcacatgctgctgcaaggcctcaccaataagctgcaggtcggagatttggactcttgtttagatataatgattgagatttttaaccatgagttgtttggtgctgttgctgaagagaaggaagtaaagcagatcctctccaaagtcatggaagcacgaagaagcaaaagttacgactcttatgaaatcctcggcaagtttgtaggaaaagatcaggttacaaaactcatccttccattaaaagagatcttacaaaataccacgagtttgaaactggcccggaaagttcatgaaactttacgccgaatcacagtgggattaattgtaaatcaggaaatgacagctgaatccattctattactcagttatggtttgatcagtgaaaatcttcccctgttaacagagaaagaaaaaaatccagtagccccagcaccagatccacgtctaccaccccagagctgccttctgcttcccccaactccagttcgaggtggacagaaagctgttgtgagcaggaaaaccaacatgcacatatttattgagtccgggcttcggctgctgcatctgagtctgaagacttccaagatcaagtcttcaggtgaatgtgtcctggaaatgctggatccttttgtgtctctcctcatagactgcctgggctccatggatgtgaaggtgatcacaggtgctttacagtgcctcatctgggtcttgaggttcccgctaccttccatagaaacaaaagcagagcagctgacaaaacacctcttccttctgctgaaggactatgcaaagctcggggccgccaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatggttaccacttggtttggagcaaaaaagcgcttaaatagacaacttgctgccctgatctgtggcttgtttgtggaaagtgaaggagttgattttgagaaaagacttggaactgtccttcctgtgattgaaaaggaaattgatcctgaaaactttaaagatatcatggaagaaactgaagaaaaagctgcagatcgccttctgtttagttttcttacactgataactaaacttatcaaggaatgtaatattattcagtttaccaaacccgctgagactttgagtaaaatctggagtcatgtgcattctcacctgagacatccacacaactgggtgtggctcacagcagcccagatttttggattactctttgcctcttgccagccagaggagcttattcaaaaatggaataccaaaaagaccaaaaaacacctcccagaacctgtagcaatcaagttcctagccagtgaccttgaccaaaagatgaaaagtatctctctcgcctcttgccatcaattgcattccaaattcttggatcagtctctaggagaacaggttgttaagaatttgttgttcgcagccaaagtcttgtatttactggaactttattgtgaggataagcaaagtaagataaaagaagacctggaagaacaagaagctttagaagatggtgtggcctgtgcagatgagaaggcggagtctgacggagaagagaaggaagaggtgaaggaagagctcggcaggccggccacgctgctgtggttgatccagaagctgtcccggattgcaaaactggaagctgcttattcgccgagaaaccccttaaagagaacatgcatctttaagttcctcggcgccgtagcaatggatcttgggatagacaaggtaaagccgtatctcccaatgatcatagctcctttgtttcgggaactcaacagcacctattcagagcaagatcctttgctgaagaatctatcccaggaaatcatagaattactcaaaaagctggttgggcttgagagcttctcattagcctttgcctctgtacagaaacaaaggagctatgatcattgggagatacggctttaccttgtctatcccaagatccattgctacggcgccgaggaacttaaagatgcatgttctctttaaggggtttctcgtcgacgcggccgca

SEQ ID NO: 426184 - DNA, 1272 bp, Homo sapiens
ataggctaggtacgaggctgggtggtgatcacttgcatccaaattcttggatcagtctctaggagaacagttgttaagaatttgttgttcgcagccaaagtcttgtatttactggaactttattgtgaggataagcaaagtaagataaaagaagacctggaagaacaagaagctttagaagatggtgtggcctgtgcagatgagaaggcggagtctgacggagaagagaaggaagaggtgaaggaagagctcggcaggccggccacgctgctgtggttgatccagaagctgtcccggattgcaaaactggaagctgcttattcgccgagaaaccccttaaagagaacatgcatctttaagttcctcggcgccgtagcaatggatcttgggatagacaaggtaaagccgtatctcccaatgatcatagctcctttgtttcgggaactcaacagcacctattcagagcaagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggagtttgtaactaatcctgatattgctgccaagaaaaaaatgaagaaacacaaaaataaaagtgaagcaaagaagagaaagatagagttcctgcgtccaggatataaggccaagagacaaaaaagccatagcctgaaagatttagcaatggtggagtaatgtctccctgtgctgatacaagcatgaactttctggaatattctgctagtctgaaattacagcaggttgtctggggtaggggggaggcgtttttttttttttttgagacaaggtctcactctgtcacccaaggtggagtgcagtgacgacatcacagctcactgcagcctcaacctgggttcaagtgatcctctcacctcagcctcccaagtagttgtgcctcctaggcacacaacactatgcccggcaaattttttgtattttgtattttttgtagaaacaggatttcgccatgttggccaggctggtctcgaacacctgggctcaactgatccgcctgcctcggcctcccaaagtgctgggattacaggtgtgagccaccctgctcaaccaggttttattatttaagttagttaaactttggatagattgtataatatatagtttaatgtaatcatgctcatattttttaaataaataaaacactatactactgaaaag

SEQ ID NO: 426185 - DNA, 5827 bp, Homo sapiens
cccaggggctcaagccgcacgtgagaaagtctgggcatctgggattcggagagtatagcctgtgagccgctttcccctccttactgtcggttgcatcccttcgacactcccgaggccgtcgcgggccactggccctctgcagccatgaagacaaagcccgtttcccacaagaccgagaacacctaccggtttcttacatttgctgaacgactggggaatgttaatattgatattattcaccggattgatagaactgcaagctatgaggaggaggttgaaacctacttttttgagggtctgctgaaatggagagaattaaacctcacagaacacttcggaaaattttacaaagaagttattgacaaatgccaatcattcaatcagttggtgtatcaccaaaacgagatagttcagagtttgaagactcacctgcaagttaagaacagttttgcctatcaaccccttttggatttggttgtacagttggcacgagatctgcagatggatttctacccacactttccagagttttttttgactatcacctcgatcctggagactcaggacacagagttgttagaatgggctttcacctcgttatcatatctttataagtacctgtggagactgatggtgaaggacatgtccagtatatacagcatgtacagcacactcctggctcataaaaaactacatataagaaattttgctgctgaaagttttacttttttgatgagaaaggtctctgataaaaacgcacttttcaatttaatgtttcttgatcttgataaacatccagaaaaagttgaaggtgttggacagttgctctttgaaatgtgcaaaggagttagaaatatgtttcactcctgtacaggccaggcagtgaagctaattttgcgaaagctaggaccagtcactgaaacagaaactcaactaccatggatgttaattggagaaacactcaaaaacatggtcaaatccactgtatcctacatctccaaggaacattttggtacattttttgaatgtttgcaagaatcgctcttggatctacacacaaaagtaacaaaaactaactgttgtgaaagttctgaacagattaaaaggttgttggaaacataccttatacttgtaaaacatggaagtgggacaaagatacccacgcctgctgatgtctgtaaggtgttatctcaaacactgcaagtagccagtctctccacatcttgctgggagaccctcttggatgtaatttctgctttgatcctgggtgaaaatgtttccttgccggagaccctcatcaaagaaaccatagaaaaaatatttgagagcagatttgaaaaacgtttaattttcagtttttctgaagtcatgtttgccatgaagcagtttgagcagctttttctaccaagctttctgtcatatattgtgaattgcttcttaattgatgatgctgtagtcaaagatgaagctctggccattctggccaagctcattctgaacaaagcagcacctcccactgctggctcgatggcaattgaaaagtaccctctggttttctcaccgcagatggtgggattctatataaagcagaagaagactagatccaagggaagaaacgaacagtttccagtattggaccatcttttatctataattaagttacccccaaataaagatactacttacctttcacaatcttgggcagccctcgtggtgttacctcatattagacctcttgagaaagagaaggtgataccactcgtcaccggcttcatagaggcactcttcatgactgttgacaaaggaagctttgggaaaggaaacttatttgttctttgtcaagctgtaaatactctactaagtttggaagaatcttctgaacttcttcatttggttcctgtggaacgtgtgaagaatttagtattaacctttcccctggagccatctgtgttgctgttgactgatctctattatcagagattagccttgtgtggctgcaaagggccactttcccaggaggctttaatggaattatttcccaagttacaagcaaacatttcaactggtgtatccaagattcggcttttgacaataaggatcctaaaccattttgatgtccagcttccagaatcaatggaggatgatgggctctcagagcggcagtctgtctttgctatattacgccaggcagaacttgttccagcaactgtgaatgattatagagagaagcttcttcatttgagaaaactaagacatgatgtggtacagactgctgtccctgatgggccgttacaggaggtgccgcttcgttatttgttaggcatgctatatattaatttcagtgcactctgggatcctgttattgaactcataagttctcatgcacacgaaatggaaaataagcaattttggaaagtctactatgagcatctagaaaaagcagctacgcatgctgagaaggaactacagaatgatatgacagatgagaagtccgttggagatgaaagttgggagcagacccaggaaggagatgttggagctctttatcatgagcagttagcattgaaaactgactgtcaggaaagacttgaccacaccaacttcagattcctgctctggagagctctgaccaaattcccagaaagagtagagccacggtccagggagctttccccgcttttcttgagatttatcaacaatgagtattacccagcagatctgcaagttgctccaacccaggatctacggagaaaaggcaaagggatggtggcagaggaaatcgaagaggaacctgccgcaggagatgatgaagagttggaggaagaggcagtgccccaagatgaatcctcacagaagaaaaagacgaggagagctgcagcaaagcaattaattgctcatttgcaagttttctctaaattttcaaatccacgggccttatatctggaatccaaactatatgagttatatcttcagttgttgctacaccaagatcaaatggtgcaaaaaataaccttggattgcataatgacatataaacatcctcatgtcctcccttacagggaaaacttacaaaggttgcttgaagacagaagctttaaggaagagatagtgcattttagcatttcagaagataatgctgtagtgaaaacagcccaccgagcagatctatttcctattctgatgagaattttgtatgggcgaatgaagaataagactgggagtaaaactcaggggaaatctgcttcaggcacccgcatggccattgtcctgcggttcctggccgggacccaacctgaggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcagaaacgcaagatatttccctttgctggctaaacagaagcctgggcacccagaatgtgatatcctgaccaatgtttttgcaattctctcagcgaagaatctttctgatgccacagccagtattgtaatggacatagttgatgaccttcttaaccttccagatttcgagcctacagaaacagttttgaacttgctggtaactggatgtgtataccctggcatagcagaaaacatcggtgagtctatcacaataggaggaagattaattctacctcatgtacctgcaattcttcagtatctcagcaaaaccacaataagcgcagaaaaggtgaaaaagaaaaagaatagagcacaagtcagtaaagagcttggcattctttcaaagatcagcaagtttatgaaagacaaagaacaaagttctgtactcattacgcttctccttccattcctccaccgtggcaatattgctgaggatacagaggttgatattctggtgacagtacaaaacttgttaaagcattgtgtggaccctacaagcttcctcaagcctatagcaaaacttttctcagttattaagaacaaattgtcaagaaaattgctttgtacggtttttgagactctttctgattttgagagtgggttaaaatatattactgatgttgtcaagcttaacgccttcgatcaaagacatcttgatgatatcaacttcgacgttcgctttgagactttccagaccatcacctcttacattaaagaaatgcaaattgtggatgttaactacctaattccagttatgcataattgtttctataatctagagttaggagatatgagtttaagtgataatgccagcatgtgcctgatgagtatcatcaaaaagctagctgccttgaatgtcacagagaaagactatagagaaatcatccaccgttcactcctggagaaattgagaaaaggtctgaagagccagacagagagtattcagcaggattataccacaatactttcctgtttaattcaaacctttccaaaccaactggaattcaaagacttggtacaacttactcattaccatgacccagaaatggacttctttgagaacatgaagcacattcagatccacagaagagcaagagccttgaagaaacttgcaaaacaactaatggaaggcaaagttgttctgtcttctaaatctcttcagaattacatcatgccttatgccatgactccaatttttgatgagaaaatgctcaagcatgaaaatataaccactgctgccacagagattattggagccatttgcaaacatctctcttggtcagcgtatatgtattacttgaaacatttcattcatgtcttacaaacgggacagatcaatcaaaaactgggtgtcagtttgctagtaatagtgttagaagcattccactttgaccacaaaactcttgaagaacaaatgggaaaaattgagaatgaagaaaacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacgactaaaagggaagaagaacacaagcttgtcaagtcaaaggttgtgaatgatgaggaagtcgttcgagttccattagcttttgccatggttaaactaatgcagtcccttccacaagaagttatggaagctaatctgccaagtattttgctgaaagtgtgtgccctactcaagaacagagcccaagaaatcagagacattgcacgcagcactcttgcgaaaataatagaggatcttggtgtgcacttcctccaatatgttttaaaaatctcaatcattatatctaaacgtc

SEQ ID NO: 426186 - DNA, 4215 bp, Homo sapiens
gaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaagagtgaaaacaaaagaagaaagagggaaaccctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggccagcactcaagaaacagctttagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttctaaaaaaaaaaa

SEQ ID NO: 426187 - DNA, 7137 bp, Homo sapiens
atggaccaaggcccttggcggtgcgttgcgcacccccggggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgtcggtgagttcagttccccaggccaagagcagctgagcggccaggcgcagcctccagagggctctgaagaccccagagggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426188 - DNA, 7018 bp, Homo sapiens
atggaccaaggcccttggcggtgcgttgcgcacccccggggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426189 - DNA, 3473 bp, Homo sapiens
aacgggtgatgcggttgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426190 - DNA, 2509 bp, Homo sapiens
cctagttcagcagctgtgtacagtgagcccctgtaaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426191 - DNA, 5481 bp, Homo sapiens
atggaccaaggcccttggcggtgcgttgcgcacccccggggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggccacggagctgctataatgcttatctcggtccac

SEQ ID NO: 426192 - DNA, 4964 bp, Homo sapiens
atggaccaaggcccttggcggtgcgttgcgcacccccggggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtgggcagccacttcgtgggcagcgctgcccacgaagtggagagtttagcaacacagtgtgcttagtcagcgtaggaatcctcactaaagcaggagaagttccattcaaagtgccaatgatagagtcaac

SEQ ID NO: 426193 - DNA, 4356 bp, Homo sapiens
atggaccaaggcccttggcggtgcgttgcgcacccccggggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataagtcagcccatatggtcctggacaaacccctgtgagagacagtttgggactcagtgttctcggttacctatgaaggacggaagttcagagaagccaaggtgtaaagtgtgaacagacctgactgaggtcaggcttggctgaccccaaatccttcattcgtaaaagctgcagttgtgcaacaggcatataagtaactcatgcttcaaggtcggccaaggccagaaacatgagaatggagctctctgaaggttctgaacatgggcatcattgcaattcccagacttcagctttgtct

SEQ ID NO: 426194 - DNA, 1937 bp, Homo sapiens
gtggttcacgagcagccagagagaaagagatgctgctccagggcacagggctagcaaggggcagccccggggctaggagccaggcctgcctcgtgggcctgggctgctcagggcactcaacccgccagtcaggggaggccactccactcgtcccccgtcaccagcgtggaggatcccgagctccccacagaccccgcgtgtctcctgcctccccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgtcggtgagttcagttccccaggccaagagcagctgagcggccaggcgcagcctccagagggctctgaagaccccagagggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426195 - DNA, 1829 bp, Homo sapiens
  misc_feature (52)..(52): n is a, c, g, or t
gacacaaccacaaaacgaaagcagcacacagaaccttacagtcagtaagagntccgtgttaatacggacacgagggggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgtcggtgagttcagttccccaggccaagagcagctgagcggccaggcgcagcctccagagggctctgaagaccccagagggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426196 - DNA, 1022 bp, Homo sapiens
aaggctaggtacgaggctgggtgtgtccaggggcctgcgcccgtcgccggctgggttgctccaggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426197 - DNA, 423 bp, Homo sapiens
ttgttggagatttcatgaatcgaagaggtgactatgatgacccaaaggtaggtcctgtgtgagtgtagggcttggtatgcttgggagattggggcagctagacttcagtcagctcctctcatcccacagtgcccctgccagccttaggaacgtggactttgtttcctgctcacttgagaaatcaccgagtcagctctctggtgttggccttcacttgatctggcttcaaacacctgtttttaaagatgattagaatctgacaggccactttgaagggctgctgtgccttgggcctgttttgttaagaaaatagaacatttcttcagaaattacaggcttcctagaaagctcgcagactgggtgtgggttttctttccgagttttctgtccagaggggccaaggcggtggctgacaaggaggga

SEQ ID NO: 426198 - DNA, 802 bp, Homo sapiens
ctgggtccgccccactcgtgggccccgggtggctgttcagtctctggtttagtaacagaaacgtctgtttcgaggaaagtgtgcctggaactctgcacatggcgtggagcagagcttcagggtcacgctcccgtgagttttgccacagcctggaggtggtttctgcctgggctgccagtagagctggcaagtccaggagtcacaacccttgtccctctcctgccaatgtgggtgggcccactgaggcctcagttacagctacatcagagcggacaccacgtcctggttccacccagctggcggtcaagggcccctctgtccagacaggagagaagcagggagtttggaaagcagagagcaagaggtggctggtctcagccctgtgacctgggccaggcctaggacgcccctgagcctcagtgttctgtctggacgagctgccctcctgcccccaccaagccctgatgtcaagccctctccctgcagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccaggtgtggggccttcctgggttcagcagggtgtggaggcggctgggtgcactcagtggcccggctgtgatgttcaggccccaggcaacatgcagtaccaccatactgcttgcctgcacctcctcc

SEQ ID NO: 426199 - DNA, 209 bp, Homo sapiens
tctcccactcccaacactttagccaataaatggccatcttgagccagcatccgcttgcttagtgaggagctgttttgtttcactgacatgctgttatgtttcttttgcaggtaccgagttttggcaattggggatgaaaaagatcaaaccaggaaagaggatgaacttaacaggtaagtactgatatatagagtagcttttcctcagct

SEQ ID NO: 426200 - DNA, 7059 bp, Homo sapiens
atggaccaaggcccttggcggtgcgttgcgcacccccggggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426201 - DNA, 4959 bp, Homo sapiens
atgctccaacctctctctccaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426202 - DNA, 2757 bp, Homo sapiens
  misc_feature (9)..(11): n is a, c, g, or t
gggggtatnnntatcgtcgatccaggcgctcgtgtcttcagatagcgtgagtccagagcatctactggctcctctacagagagtcatgatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426203 - DNA, 3288 bp, Homo sapiens
atggaccaaggcccttggcggtgcgttgcgcacccccggggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaagtcggtgagttcagttccccaggccaagagcagctgagcggccaggcgcagcctccagagggctctgaagaccccagagggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426204 - DNA, 4622 bp, Homo sapiens
atggaccaaggcccttggcggtgcgttgcgcacccccggggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaagccgtttctgggatggttccatgtggccctcgcagggcaagaagaaaaggccagccctgtctcccttatcagcaggtccgggaagcgcacagcacctgcctggctgcatttggccttgcagtggccctcctgtctctcctctcatgggtgacttgaacacagaatgggacctagcaccctgccgggcatttatgttcattctcccattggtccttcaggcttccttgtttggttggtgtactttttgctaggtttgcttactttacctttgaggaaattcctatgtaagtaacgtgcccaaggtcacagtgcttgtaagtaccagggccaggatttgaacataggagggtctgtaaccact

SEQ ID NO: 426205 - DNA, 1859 bp, Homo sapiens
gtggttcacgagcagccagagagaaagagatgctgctccagggcacagggctagcaaggggcagccccggggctaggagccaggcctgcctcgtgggcctgggctgctcagggcactcaacccgccagtcaggggaggccactccactcgtcccccgtcaccagcgtggaggatcccgagctccccacagaccccgcgtgtctcctgcctccccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaattt

SEQ ID NO: 426206 - DNA, 3288 bp, Homo sapiens
atggaccaaggcccttggcggtgcgttgcgcacccccggggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcctgcccgcgcgtcaggaagaacagcagcaccacgacgacgaattccgcaccacaacggatacgccac

SEQ ID NO: 426207 - DNA, 2840 bp, Homo sapiens
atggaccaaggcccttggcggtgcgttgcgcacccccggggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaagtcggtgagttcagttccccaggccaagagcagctgagcggccaggcgcagcctccagagggctctgaagaccccagagggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctggcgagtccgatgcccgtccctgctggacctggaggggccccctgcctcccgctttggctcctggaagcctcccggtggggttggccggcccggcgcggcccctctcccggctgccttcgcccaagggggcccaaggcccgccgggcgcccgcactccgcggtcgtgtttaa

SEQ ID NO: 426208 - DNA, 512 bp, Homo sapiens
aaaaagtagttagaaagaataaagaagacctagtatttgacagcacaacagggtgaatataatcataatgactgcacattttaaaataatgaaaagagtagaattggattgtaacacaaaggagaaatgtttgaggggatggataccccgtttaccctgatgtggttattgcatgttgcatgcctgtaccaaagtatctcatgtaccctgatatggtgtggttctgcatctccacccaaatctcacctcgaattgtaataatccccacatgtcaaaagtgggaccaggtggtgataattgaatcatgggggcagtttcccatatactgttttcatgacagtgagtcctcatgagatcagatggttttataagaggcttcccccttcgctcagcattcattctctctcctgacaccatgtgaagaggtgccttctgccatgattgtaagtttcctgaggcctccccagccatgtggaactgtgagtcaattaaatatctttcctttataaatt

SEQ ID NO: 426209 - DNA, 2580 bp, Homo sapiens
tcccccctcttaaaacacgatgcctcccaggatgctagtggcaccactgccactgcatttcctgttggcagcagtgagcagtgaaaaccgaagcggcagaaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgatgccaggacgcgctcccctccgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagagattatttgaatatattttgctgtataaggatggagtgatgtttcagattgaccaagccaccaagcagtgctcaaagatgaccctgacacagccctgggatcctcttgacattcctcaaaactccacctttgaagaccagtactccattggggggcctcaggagcagatcaccgtccaggagtggtcggacagaaagtcagctagatcctatgaaacctggattggcatctatacagtcaaggattgctatcctgtccaggaaacctttaccataaactacagtgtgatattgtctacgcggttttttgacatccagctgggtattaaagacccctcggtgtttacccctccaagcacgtgccagatggcccaactggagaagatgagcgaagactgctcctggtgagcctgtgcatagggaagcggcagcatcggatgtcagccccctgcggccccagctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtggccatatgaactgactagatggctaatatggacactttgggtatttctaatgcctgttcagggctggttttctgcatgcacgggtatacacataatgcagtgccatgcacatagggaagggtcagtaagagaagtttgccttggcagcaagtatttattgttgacattattcagaattagtgataataaaaagcagagtgattttggtcaattttattattaattcttaaattccctgcagagaatgccccctttattgctgcaccagggtgggcattgctcccactgagccctactccaccctgtccctgcactcccttggttgccaaaaaaatgataacttaaatcccttccagacttaagaattttatggcatggcccaattgatataaacatttagaaggaaatgaaaagctaaaataggaagtaattattcctctaaagaaacattttgagcaaggcagtttagagaatcctaatgtctacactggcatagcacgagccatgtaagcttcttttttttctatgcaagagtattgatgtatgtgctgaatcttcacagacttgtcaatacacaggcagtattctaaaatagcactgaacagggagtcaggagactattgtctcctaaacccaggactagagttccctcgtactgtcactcctttggtcattaaatgcactgggcttgcccgcactttggccttcctagaacgctgcttcataacctctctgtctgacttctgcatctccttccaggtcagctcattcacaagagttgctcccaagcctggatgagttgcaccttgcatcttgagcatgcatttctcacaataattattaagctgtgtgataatttctgctttcaggacactcatccattatcttggctgtgagctccttgggtacgggtaccttgtatgtttaattttatatccctagcacaaagcaagtgcctggcacatagtcagtgccctaagtatttgtagagtgaagaatgccagcctctcttgtccctggtttccttatgtgttgaatgtggttgagtttgtccattgctagggagagacttccagtaataaaatttactattctagatgcttctactgttatgttttatctgcccatttatctttcttagttaccaggagaaatgtgtgacacctatattataatgaaaacaatcttattacttatagtttatctatattaaacaaatttaattgcatttaaagcattctttgatattgttgcttttgcaataaatatggataatcttggttataagggagttaaaacaatgctgtaataaataaagtgtttcatgtgatcaaaa

SEQ ID NO: 426210 - DNA, 2593 bp, Homo sapiens
tcccccctcttaaaacacgatgcctcccaggatgctagtggcaccactgccactgcatttcctgttggcagcagtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgatgccaggacgcgctcccctccgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagagattatttgaatatattttgctgtataaggatggagtgatgtttcagattgaccaagccaccaagcagtgctcaaagatgaccctgacacagccctgggatcctcttgacattcctcaaaactccacctttgaagaccagtactccattggggggcctcaggagcagatcaccgtccaggagtggtcggacagaaagtcagctagatcctatgaaacctggattggcatctatacagtcaaggattgctatcctgtccaggaaacctttaccataaactacagtgtgatattgtctacgcggttttttgacatccagctgggtattaaagacccctcggtgtttacccctccaagcacgtgccagatggcccaactggagaagatgagcgaagactgctcctggtgagcctgtgcatagggaagcggcagcatcggatgtcagccccctgcggccccagctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtggccatatgaactgactagatggctaatatggacactttgggtatttctaatgcctgttcagggctggttttctgcatgcacgggtatacacataatgcagtgccatgcacatagggaagggtcagtaagagaagtttgccttggcagcaagtatttattgttgacattattcagaattagtgataataaaaagcagagtgattttggtcaattttattattaattcttaaattccctgcagagaatgccccctttattgctgcaccagggtgggcattgctcccactgagccctactccaccctgtccctgcactcccttggttgccaaaaaaatgataacttaaatcccttccagacttaagaattttatggcatggcccaattgatataaacatttagaaggaaatgaaaagctaaaataggaagtaattattcctctaaagaaacattttgagcaaggcagtttagagaatcctaatgtctacactggcatagcacgagccatgtaagcttcttttttttctatgcaagagtattgatgtatgtgctgaatcttcacagacttgtcaatacacaggcagtattctaaaatagcactgaacagggagtcaggagactattgtctcctaaacccaggactagagttccctcgtactgtcactcctttggtcattaaatgcactgggcttgcccgcactttggccttcctagaacgctgcttcataacctctctgtctgacttctgcatctccttccaggtcagctcattcacaagagttgctcccaagcctggatgagttgcaccttgcatcttgagcatgcatttctcacaataattattaagctgtgtgataatttctgctttcaggacactcatccattatcttggctgtgagctccttgggtacgggtaccttgtatgtttaattttatatccctagcacaaagcaagtgcctggcacatagtcagtgccctaagtatttgtagagtgaagaatgccagcctctcttgtccctggtttccttatgtgttgaatgtggttgagtttgtccattgctagggagagacttccagtaataaaatttactattctagatgcttctactgttatgttttatctgcccatttatctttcttagttaccaggagaaatgtgtgacacctatattataatgaaaacaatcttattacttatagtttatctatattaaacaaatttaattgcatttaaagcattctttgatattgttgcttttgcaataaatatggataatcttggttataagggagttaaaacaatgctgtaataaataaagtgtttcatgtgatcaaaa

SEQ ID NO: 426211 - DNA, 752 bp, Homo sapiens
tcccccctcttaaaacacgatgcctcccaggatgctagtggcaccactgccactgcatttcctgttggcagcagtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgatgccaggacgcgctcccctccgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagagtgcacctggagaatgatgccatttcaaggactcagtgctggttgctactgctggcagattgggcatccatcagcggctgtggccaggctgaccttgttgtgagt

SEQ ID NO: 426212 - DNA, 414 bp, Homo sapiens
ctcttgtccctggtttccttatgtgttgaatgtggttgagtttgtccattgctagggagagacttccagtaataaaatttactattctagatgcttctactgttatgttttatctgcccatttatctttcttagttaccaggagaaatgtgtgacacctatattataatgaaaacaatcttattacttatagtttatctatattaaacaaatttaattgcatttaaagcattctttgatattgttgcttttgcaataaatatggataatcttggttataagggagttaaaacaatgctgtaataaataaagtgtttcatgtgatcaaaatcaaatttgttatcctctctcaaaagcctgctctccctcttaccttccctaaactccagtgtccatttgccaaggccagaagctt

SEQ ID NO: 426213 - DNA, 2693 bp, Homo sapiens
  misc_feature (2602)..(2603): n is a, c, g, or t
tcccccctcttaaaacacgatgcctcccaggatgctagtggcaccactgccactgcatttcctgttggcagcagtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgatgccaggacgcgctcccctccgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagagattatttgaatatattttgctgtataaggatggagtgatgtttcagattgaccaagccaccaagcagtgctcaaagatgaccctgacacagccctgggatcctcttgacattcctcaaaactccacctttgaagaccagtactccattggggggcctcaggagcagatcaccgtccaggagtggtcggacagaaagtcagctagatcctatgaaacctggattggcatctatacagtcaaggattgctatcctgtccaggaaacctttaccataaactacagtgtgatattgtctacgcggttttttgacatccagctgggtattaaagacccctcggtgtttacccctccaagcacgtgccagatggcccaactggagaagatgagcgaagactgctcctggtgagcctgtgcatagggaagcggcagcatcggatgtcagccccctgcggccccagctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtggccatatgaactgactagatggctaatatggacactttgggtatttctaatgcctgttcagggctggttttctgcatgcacgggtatacacataatgcagtgccatgcacatagggaagggtcagtaagagaagtttgccttggcagcaagtatttattgttgacattattcagaattagtgataataaaaagcagagtgattttggtcaattttattattaattcttaaattccctgcagagaatgccccctttattgctgcaccagggtgggcattgctcccactgagccctactccaccctgtccctgcactcccttggttgccaaaaaaatgataacttaaatcccttccagacttaagaattttatggcatggcccaattgatataaacatttagaaggaaatgaaaagctaaaataggaagtaattattcctctaaagaaacattttgagcaaggcagtttagagaatcctaatgtctacactggcatagcacgagccatgtaagcttcttttttttctatgcaagagtattgatgtatgtgctgaatcttcacagacttgtcaatacacaggcagtattctaaaatagcactgaacagggagtcaggagactattgtctcctaaacccaggactagagttccctcgtactgtcactcctttggtcattaaatgcactgggcttgcccgcactttggccttcctagaacgctgcttcataacctctctgtctgacttctgcatctccttccaggtcagctcattcacaagagttgctcccaagcctggatgagttgcaccttgcatcttgagcatgcatttctcacaataattattaagctgtgtgataatttctgctttcaggacactcatccattatcttggctgtgagctccttgggtacgggtaccttgtatgtttaattttatatccctagcacaaagcaagtgcctggcacatagtcagtgccctaagtatttgtagagtgaagaatgccagcctctcttgtccctggtttccttatgtgttgaatgtggttgagtttgtccattgctagggagagacttccagtaataaaatttactattctagatgcttctactgttatgttttatctgcccatttatctttcttagttaccaggagaaatgtgtgacacctatattataatgaaaacaatcttattacttatagtttatctatattaaacaaatttaattgcatttaaagcattctttgatattgttgcttttgcaataaatatggataatcttggttataagggagttaaaacaatgctgtaataaataaagtgtttcatgtgatcaaaaaaaaaaaannttaacctatttaccctctctcttcccaaattatattctattaaaaaacctttgtggccgctttggccaatcattttccttaccttttttc

SEQ ID NO: 426214 - DNA, 2384 bp, Homo sapiens
tcccccctcttaaaacacgatgcctcccaggatgctagtggcaccactgccactgcatttcctgttggcagcagtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgatgccaggacgcgctcccctccgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagagatgaaacctggattggcatctatacagtcaaggattgctatcctgtccaggaaacctttaccataaactacagtgtgatattgtctacgcggttttttgacatccagctgggtattaaagacccctcggtgtttacccctccaagcacgtgccagatggcccaactggagaagatgagcgaagactgctcctggtgagcctgtgcatagggaagcggcagcatcggatgtcagccccctgcggccccagctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtggccatatgaactgactagatggctaatatggacactttgggtatttctaatgcctgttcagggctggttttctgcatgcacgggtatacacataatgcagtgccatgcacatagggaagggtcagtaagagaagtttgccttggcagcaagtatttattgttgacattattcagaattagtgataataaaaagcagagtgattttggtcaattttattattaattcttaaattccctgcagagaatgccccctttattgctgcaccagggtgggcattgctcccactgagccctactccaccctgtccctgcactcccttggttgccaaaaaaatgataacttaaatcccttccagacttaagaattttatggcatggcccaattgatataaacatttagaaggaaatgaaaagctaaaataggaagtaattattcctctaaagaaacattttgagcaaggcagtttagagaatcctaatgtctacactggcatagcacgagccatgtaagcttcttttttttctatgcaagagtattgatgtatgtgctgaatcttcacagacttgtcaatacacaggcagtattctaaaatagcactgaacagggagtcaggagactattgtctcctaaacccaggactagagttccctcgtactgtcactcctttggtcattaaatgcactgggcttgcccgcactttggccttcctagaacgctgcttcataacctctctgtctgacttctgcatctccttccaggtcagctcattcacaagagttgctcccaagcctggatgagttgcaccttgcatcttgagcatgcatttctcacaataattattaagctgtgtgataatttctgctttcaggacactcatccattatcttggctgtgagctccttgggtacgggtaccttgtatgtttaattttatatccctagcacaaagcaagtgcctggcacatagtcagtgccctaagtatttgtagagtgaagaatgccagcctctcttgtccctggtttccttatgtgttgaatgtggttgagtttgtccattgctagggagagacttccagtaataaaatttactattctagatgcttctactgttatgttttatctgcccatttatctttcttagttaccaggagaaatgtgtgacacctatattataatgaaaacaatcttattacttatagtttatctatattaaacaaatttaattgcatttaaagcattctttgatattgttgcttttgcaataaatatggataatcttggttataagggagttaaaacaatgctgtaataaataaagtgtttcatgtgatcaaaa

SEQ ID NO: 426215 - DNA, 108 bp, Homo sapiens
ctgcagccaagacactgattttctgctcctacagcctggtaaccttgtagtaaataggactacgtcctttaaactactcaggagcaaagttagacttccacgaaaaag

SEQ ID NO: 426216 - DNA, 3402 bp, Homo sapiens
cgggaaccgccgccggtatccgcgtccgcagcgccgccagccaggcgagagccgtgtgggatcccagcgcccgcactcccgcccccgccaaggagccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaacaaa

SEQ ID NO: 426217 - DNA, 3474 bp, Homo sapiens
agccgctgctgggagacgcctgggcgccgggggctgcaggtcccagggcgggggctgcgtccgtcaccggcaggtacccaggtatgccgcagagccaggcacgccgtgggcactcagtcagtatctgtggaatgaatgaatgatggtcgtccctgggagcttatctctgaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaacaaa

SEQ ID NO: 426218 - DNA, 1562 bp, Homo sapiens
tttgagatggagcctcactctgttgcccaggctggagtgcagtggcaagaaatagcatcgttgcaagtccttccggcccttgttggtgtcttaccacagccctcccttaactctgtcgtcccagattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaacaaa

SEQ ID NO: 426219 - DNA, 353 bp, Homo sapiens
agaaacattgaactgcaaaacacaacaacatgttctctcaatggctttcataacttggcttggtttgctggcagttttggcaggctgctgcctcaatcactccgcttgtccctattgttattaaaaaaaaaaaaaaaagaatcaggacagcccagtgttagaatagagtggcggaggtaccaagaaaggattcctgctatccagaaataattccactattctattccagctttctgcttcctgtaacaccagatttcagccttcttcccaagataattttacaagccttctccttatctttggtgagctcctttctgctcatatttctgggcaagaagattgccagtcttcac

SEQ ID NO: 426220 - DNA, 476 bp, Homo sapiens
ggtcggtacctctgtgcgcatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctaaatgcggcacagagtaccgaccga

SEQ ID NO: 426221 - DNA, 723 bp, Homo sapiens
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggttatgcaatggtctctgcaagatggtttattcttgaattggacctttttaagactgacaaat

SEQ ID NO: 426222 - DNA, 697 bp, Homo sapiens
ctcttatttcctgtcaactaatttgaatttcttcttgagtgtctcacttggttatcaagatattaaattatagggttaaataatagtggtcaaagcgtattttatttttacaaaaatgtacctttcattcttaaattattcagagactttcattttgcatttattaccctttcttttggtctgtgcttctcacttaattttacttgattatcaaagtcaacttaccattaaatcattgaatagtgtgtttaagataactgaggatatggtttgaatttaaatgcccaacaaaaatatatgttgaaagggatgaatacttttatcattttgaaaccaggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgaggtttgtgaataactaatctattggtgctaattcttaattatttgatattttc

SEQ ID NO: 426223 - DNA, 9600 bp, Homo sapiens
cttttctcaagacaactacataagcagacaaaattgcaaagatctgccctgtgtcgagtatgacagccacgactcgtggctctccggtcggagggaatgacaaccagggccaggctcctgatggacagtctctgccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcattcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaaagaggactgcatattaaaattcattctgtgcatagcatgcctaggcatgacactgattcaggatttcagtcacatcaagtttttgtgcacagaaagttttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaa

SEQ ID NO: 426224 - DNA, 8972 bp, Homo sapiens
cttttctcaagacaactacataagcagacaaaattgcaaagatctgccctgtgtcgagtatgacagccacgactcgtggctctccggtcggagggaatgacaaccagggccaggctcctgatggacagtctctgccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcattcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgatta

SEQ ID NO: 426225 - DNA, 8650 bp, Homo sapiens
cttttctcaagacaactacataagcagacaaaattgcaaagatctgccctgtgtcgagtatgacagccacgactcgtggctctccggtcggagggaatgacaaccagggccaggctcctgatggacagtctctgccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcattcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctcactgcattgcccaggctggattgtatgtggctattcaccggaaagagcatagtatgttacagcctccacctcctgtaccaagatgtccgcctgcccagcctcctgataagctggtcagacataacggtgtcctctagatc

SEQ ID NO: 426226 - DNA, 9648 bp, Homo sapiens
cttttctcaagacaactacataagcagacaaaattgcaaagatctgccctgtgtcgagtatgacagccacgactcgtggctctccggtcggagggaatgacaaccagggccaggctcctgatggacagtctctgccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcattcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggtaaaaaaagccaccagtgtgcagcagatagaaatggaagagagcaaagagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaaagaggactgcatattaaaattcattctgtgcatagcatgcctaggcatgacactgattcaggatttcagtcacatcaagtttttgtgcacagaaagttttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaa

SEQ ID NO: 426227 - DNA, 9800 bp, Homo sapiens
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaaagaggactgcatattaaaattcattctgtgcatagcatgcctaggcatgacactgattcaggatttcagtcacatcaagtttttgtgcacagaaagttttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaa

SEQ ID NO: 426228 - DNA, 9620 bp, Homo sapiens
cttttctcaagacaactacataagcagacaaaattgcaaagatctgccctgtgtcgagtatgacagccacgactcgtggctctccggtcggagggaatgacaaccagggccaggctcctgatggacagtctctgccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaaagaggactgcatattaaaattcattctgtgcatagcatgcctaggcatgacactgattcaggatttcagtcacatcaagtttttgtgcacagaaagttttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaa

SEQ ID NO: 426229 - DNA, 6126 bp, Homo sapiens
tcggtacccactagtccacggttggctgacaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaaagaggactgcatattaaaattcattctgtgcatagcatgcctaggcatgacactgattcaggatttcagtcacatcaagtttttgtgcacagaaagttttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaa

SEQ ID NO: 426230 - DNA, 5186 bp, Homo sapiens
tcacaaaactcattcttatggtgcacattctagttagctgatagacggcttcaaaaccctgattaacagactgagccagaagagcagcaaattcctggttgttgaagatcttcagattacagcctggtggaattttacacactgttgcagggtgccagccatatctctgattacaattggggctctgcacaaagattgcactatcacttaggcacacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaaagaggactgcatattaaaattcattctgtgcatagcatgcctaggcatgacactgattcaggatttcagtcacatcaagtttttgtgcacagaaagttttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaa

SEQ ID NO: 426231 - DNA, 3165 bp, Homo sapiens
cgctctagaggctcccggttacctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaaagaggactgcatattaaaattcattctgtgcatagcatgcctaggcatgacactgattcaggatttcagtcacatcaagtttttgtgcacagaaagttttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaa

SEQ ID NO: 426232 - DNA, 9708 bp, Homo sapiens
  misc_feature (8208)..(8210): n is a, c, g, or t
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtataaaaaaaaaaaaaaaaaaaaaaaaaaaaaaaaaaaaaaaaaaaaaaaaaaaaaaaaaaaaannnaaaaaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaaagaggactgcatattaaaattcattctgtgcatagcatgcctaggcatgacactgattcaggatttcagtcacatcaagtttttgtgcacagaaagttttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaa

SEQ ID NO: 426233 - DNA, 8413 bp, Homo sapiens
  misc_feature (8203)..(8203): n is a, c, g, or t
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtataaaaaaaaaaaaaacctcgggttttttttttttttttttttttttcaattggaaaanggttaatttcttaaggggggttaccggctttaaaaaccaccccggatttcggtttaatttaaaaaaacccccccggatggggggttcattttatttacccccccccaaaatttctttgacccttaagggccgttgggaaactttaaacctaaccccacaattactccttgaaagccccttaattaattttttcccaattgaacacaaaca

SEQ ID NO: 426234 - DNA, 8163 bp, Homo sapiens
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaaccccgatgcggcagatatacgaatatggccacaatcgccgcgtcactgcaaac

SEQ ID NO: 426235 - DNA, 2605 bp, Homo sapiens
tctcacatttacctctgaggactttcatcgtccattcaccttctccactcttcatgattaccgtcatctcattccttattatccataatctttgtcgtatgtccggctatgcaagaataggccgaaaggggccttcggaagtggtttgctagcggcggagctcggcggcgcggtcctgggtggcgggcggcgtgcgggcaggcgagcggagcccccggagccaagttactcacgggagcggagagaaaaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaaagaggactgcatattaaaattcattctgtgcatagcatgcctaggcatgacactgattcaggatttcagtcacatcaagtttttgtgcacagaaagttttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaa

SEQ ID NO: 426236 - DNA, 2608 bp, Homo sapiens
gaaatcccatctccactaaaaatagaaaaattagtcgggcgtggtggcaggcgcctgtaatctcagctacttgggaggctgaggctggagaatgacttgaacccaggaggcacagattgcagtgagcggagatcgtgccagtgggctccagcttgggtgacaagagtgaaactccatctcaaaaaaagaaaagaaaagaatgtttattctatgtcattttaagctaatgaagggagctttcttttggagaaatttctgtgaaattgcctgaaatgtagtagttctgagagaatgcaaatcaggttttttgttttgtttttttttttttgttttttccccaagttctttatctgcagtaaaagaaaagttgctaatgggtcagttttgtagatttttaaaatttatttcaaatagaaaaagttaaaagtaaacttgagtttgcctacgtaattttttatcttgaaatattcaaaattaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaaagaggactgcatattaaaattcattctgtgcatagcatgcctaggcatgacactgattcaggatttcagtcacatcaagtttttgtgcacagaaagttttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaa

SEQ ID NO: 426237 - DNA, 7658 bp, Homo sapiens
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggtgaaaattacatctgaaataccacagactgagagaatgcagaagagggctgaacgattcaatgtacctgtgagcttggagagtaagaaagctgctcgggcagctaggttagggatttcttcagttccaacaaaaggtctgtcatctgataacaaacctatggttaacttggatc

SEQ ID NO: 426238 - DNA, 7772 bp, Homo sapiens
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaacacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaaagaggactgcatattaaaattcattctgtgcatagcatgcctaggcatgacactgattcaggatttcagtcacatcaagtttttgtgcacagaaagttttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaa

SEQ ID NO: 426239 - DNA, 7255 bp, Homo sapiens
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctaaatgcggcacagagtaccgaccga

SEQ ID NO: 426240 - DNA, 5451 bp, Homo sapiens
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacatagttcagcgtctgacggtaccggct

SEQ ID NO: 426241 - DNA, 5317 bp, Homo sapiens
  misc_feature (5225)..(5225): n is a, c, g, or t
  misc_feature (5254)..(5254): n is a, c, g, or t
  misc_feature (5262)..(5262): n is a, c, g, or t
  misc_feature (5310)..(5310): n is a, c, g, or t
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttcctccgaactggccaantacctaatgttgcccaagaaaggattttngggaaaancaagtttccaaggcttttggggggttaagccccgtttaaatcctggcnttgaaac

SEQ ID NO: 426242 - DNA, 5526 bp, Homo sapiens
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggtaaactatggatggacagtaatagagatacttcttaaaatgaacatctcaatacactaacattaaacctctaaaagacatgttggaaggcatctttttttaagcactggtaatattcaaactgtccttaattgggtgggtttttttttttttttttaggtccccttaggaagaagtagaaactgccatagtaagtaagggcaacatcctttagtctcttaaccatattattaactttttattaggaaaacatctaataaatacagaagtag

SEQ ID NO: 426243 - DNA, 4250 bp, Homo sapiens
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacaggtaatacagacttttcaaaaatccttttataatagtagatagcaatttttaaagtaaaactaattagtattttaagtgtagagttcaaggttgactcaatgttcaaagtgccttatttcagaggttttctttatgatgtttgtattaaaagtgcaaatacttttcgctgacagctgataatctgagggtagtttctccctgcccacttaaatcttgcttgactttcatttattttaaacctaacaaaaactccatatgaatctcttattaacttgtgcctggtagatatataaagacacagattgtaataagagatataattggtttatcttgttgcttgtttcccttcccaccttgggcttaaacccaagttctgagcttattctgactcggtttctgccttggtggcattcttgatccatgtcacaaaaaattctcaagacatgccagaat

SEQ ID NO: 426244 - DNA, 4664 bp, Homo sapiens
ccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaagtaagtatcttttttaattgtaagaaacttactttttgtaaatggagtgaattaatttaggctggcaaaatgtgtccccaaaattaaatatttattgtctctatggcatattggtattgaggaaaattttattatttaagagtgttttgcttaacctaaatgtttggttttagtctctgcaaatgccaatattaattgtcaaagcatgatttttttctaatcttagaatttagttttacctgggaggtatatagattagcctatttctaaaaatctagtttgcaagatttaaatcatataggacattagcctcctatcttagattcctagatgccaggttttttttaaagccaaacagaatttgatatgaaatttgtaagacagggtcattgtaagaacttttgcagtttacactgataataaagatcagttataaagctcatgtttt

SEQ ID NO: 426245 - DNA, 605 bp, Homo sapiens
acaagttatgtgaagaaaatcattgaagactgcagtaattcagaggaaaccgtcaaattgcttcgtttttgctgctgggagaatcctcagttctcatctactgtcctcagtgaacttctctggcaggtaaaaggaaaataacatttgtatgtttataatttgatttgttattcctttcattaagttactcaccatgtcttacttgtttttaggttgcatattcctatacctatgaactgcggccctatttggatctgcttttgcaaatcttactgattgaggactcctggcaaactcacaggtggatactctttttgtgactggaaacaattaggcttgcccaggtgttagagttaactgaaattgacagtcaccacattttttttaacctattggagttctagtgaatgttttatcttaaacctaggacaagggtaaataacaggttctccccttttcctcagaattttatttccttttttattcttttttctcactgcctaagtttcatacttaataagcctgtttctttagaatgacttttttaattaaggaggagctagcttgggcatttggtaaatatttgaatttcattaatgatgccc

SEQ ID NO: 426246 - DNA, 4095 bp, Homo sapiens
cagggctggctttggtcagctgagagcactgagtaaataggttggtggggtccatgttgggaagaggggtgagcacatttccctggtatcttggctgaagaatccaggctggagatgacagaggaggccatggtggagagttgattgcatccttatgttgaaatggagatcatgttcagctggggggcctctgtggtctccccagctgtcaagggctgcctccctctgttctgacctcatcgttattctggcagagtatactctgaagcgctggcttattttggaggggatgcaaagttttctcccacctaccctgtggggcagactcaaacataattctttgcttttttcttccccctttgcctgacttgcagttcgtctaatgattgaaaatccttacgagacccgctctgacagcttctactttgttgacaacaagctgataatgcacaacaaggctgattatgcctataatggaggccagtaagtgctgcaagagtaggtaggggaggtgctttgccgcggccacaagatcctggcacacggagatgatcgaagctgcagtttgtcaacacacatctggaacctggccccaggaagccaaggctggggtggcagtttcctgcgcgccaaaggagctgccaaacagtgctgtgttttcttccccagtattttttcttccctttttttcctgccccgtaggttgcagaggtactatagtaaagtaaaaggttaggataagggtcctggaatccagataaaaaagtttattttccgtagttctggctgcctgttggttgtcttgacgaccaggcatagctgtgcctggtgagaaggctctggccaggcccaccagcaggtcagcagctcttaaggttcctgggtgctgtgggaagctgaaaggtaggcctcttccaggtagctcctcctctcacctccggcattgccatcagcgcagtctgccctcggtctgtgtgaagtcttaaaccaactggaagacacttgaaagggtggggagggagggaggtgccaagagtggaggcaccaaggaatgggtgatgctgccaagctgaagggtctgctttgtggagaggctgctgctctgtctgacttccagggtctcagccagccctcctgggaatagaccaagttttcagcctggcagtgccttctgttcccattttggaggacagacaagcttgctccacatctcctggctcctcccttctgagtctcatgaaatagaatgagtcagctctgctcatggaacagtagtatctcttgaggccagagcaggtcttgtattttgtttttttatttccagacttctttcggggaggttttataaaatgacagtggtgttcccagcatatgtgatatgtggttagacttctgatagtatcagcttccaggggctaatctggcttatgttgggaggatatgcttacgaatcagcagcagctttctaaaggagagatttgacttttctctgcactgcacagcctggaggattggcttttgatggggatttgcctccgaagctctttgtacatttcttgtttaggagggttttcctatctacctttctactgaagtagtttctggaactttcctggtggatcagagttacgtaatgcagtctgagccttcagactgctagttagaattgttttaggtgttcagaaagggcaaaataggctgatgtggcctgtcagagtgatgtgttctcaaaaaagttcacttgcacatctgtgggctgcttttgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctttagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatgtggttctggagctgcccagagctgtgcttagtagagtgtgtcttggaaacatgcccctgggcacactgtatctgctacattagtgggctatctcttatctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaattgcaaggcatactttctctgaaagtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccagagggcctgcccctcctgcttctgttcctttgccttgcagtctcctggagagagcctctcttttcctgtacagcctttgggccaaaatgcccttctagcttctccaaagaagatccgagtttatttcattctatgttttaagaggtaaaaggacataacaagtgaaagaagttttgggctaaagtaggctatgtctccttatgtattactcaatactgttttgcagagaaaacatttttcaagcatgtgcttcctgaagacacctcagtctttgggccatttgatttccaatacatagggtggaagaatgtgattttggggctgaccataaactggaaatttgtgaaatggcagtgattgggcaatcttcagtttattttttcagttgaagtggaactcatttctggaatggatttaataggctgtgtctaatgtacaaactgggtgagtcctgccttagtgtgtcctgccccaccggtacgcttccaggatactcttttcccctctgtaaagtcactttcttctgatggccagtgtcactatgatgtcagtgaggtctggggatgaggacagtgtgtcctgaaattcacaggactgactcctcaccccagtgcacgaggattcctgtggcatcaggtgctgctgtacctggtgtaggagcctaatcattgaaccattgtgttactcacattccatgtcacagaacatatcagcctcaagaaggatttggtggaggtggatttaccactggttttacaaaggaccgtgtaaagtcattgaagttgtgaaagtctattttttttcctgtaaatctattttttacagaatataagaaacatcaatgacctgatctgtccttcctcctccttcccgcttcccccaaaatcacattccagtttttattgtctttgtgtccaaagtaaactaggtgacttatttgtataaaatgttattttgccacatgagacagtaataaaagaaagattttcacagta

SEQ ID NO: 426247 - DNA, 2007 bp, Homo sapiens
ggtaagctaggaccttctcagtgagaaagctgccagcatgtggcattgccaagactctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatgtggttctggagctgcccagagctgtgcttagtagagtgtgtcttggaaacatgcccctgggcacactgtatctgctacattagtgggctatctcttatctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaattgcaaggcatactttctctgaaagtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccagagggcctgcccctcctgcttctgttcctttgccttgcagtctcctggagagagcctctcttttcctgtacagcctttgggccaaaatgcccttctagcttctccaaagaagatccgagtttatttcattctatgttttaagaggtaaaaggacataacaagtgaaagaagttttgggctaaagtaggctatgtctccttatgtattactcaatactgttttgcagagaaaacatttttcaagcatgtgcttcctgaagacacctcagtctttgggccatttgatttccaatacatagggtggaagaatgtgattttggggctgaccataaactggaaatttgtgaaatggcagtgattgggcaatcttcagtttattttttcagttgaagtggaactcatttctggaatggatttaataggctgtgtctaatgtacaaactgggtgagtcctgccttagtgtgtcctgccccaccggtacgcttccaggatactcttttcccctctgtaaagtcactttcttctgatggccagtgtcactatgatgtcagtgaggtctggggatgaggacagtgtgtcctgaaattcacaggactgactcctcaccccagtgcacgaggattcctgtggcatcaggtgctgctgtacctggtgtaggagcctaatcattgaaccattgtgttactcacattccatgtcacagaacatatcagcctcaagaaggatttggtggaggtggatttaccactggttttacaaaggaccgtgtaaagtcattgaagttgtgaaagtctattttttttcctgtaaatctattttttacagaatataagaaacatcaatgacctgatctgtccttcctcctccttcccgcttcccccaaaatcacattccagtttttattgtctttgtgtccaaagtaaactaggtgacttatttgtataaaatgttattttgccacatgagacagtaataaaagaaagattttcacagta

SEQ ID NO: 426248 - DNA, 4867 bp, Homo sapiens
gctgggcccggggggctggtggctggcaaggaggagaagaagaaggcgggcggcggcgtcctgaaccgcctgaaggcgcggcggcaggcgccccaccacgcggccgacgacggcgtcggggcagcggtcacggagcaggagctgctggcgatggacaccatccggcccgagcacgtcctgcgcctcagccgggtcaccgagagagtgtgcactcacctagttaggcctatcttggcctgcccatcactcctggcgtgcagtctcctaaccctgtggcagcagcaacattccctggatggatcgaaggctgccatggtgtctgctgagctgctatagcaggcagcccagggctgttcagattatttatgtaaacccgaagacaacatctacagtattgatttcacccgcttcaaaattcgagatttggagacagggacagtactttttgagattgccaaaccttgcgtttcagaccaggaggaggatgaggaggagggaggtggagacgtggacatcagcgcaggacgttttgtccgctatcagttcacaccggcatttctccgcctccggacagtcggggctacggtggagttcacagtgggagacaaacctgtttcaaacttccggatgatcgaacggcactatttccgggaacacttgctgaaaaactttgactttgattttggcttctgcatccccagcagtaggaacacttgtgaacatatctatgagtttccccagctttcggaggatgtcattcgtctaatgattgaaaatccttacgagacccgctctgacagcttctactttgttgacaacaagctgataatgcacaacaaggctgattatgcctataatggaggccagtaagtgctgcaagagtaggtaggggaggtgctttgccgcggccacaagatcctggcacacggagatgatcgaagctgcagtttgtcaacacacatctggaacctggccccaggaagccaaggctggggtggcagtttcctgcgcgccaaaggagctgccaaacagtgctgtgttttcttccccagtattttttcttccctttttttcctgccccgtaggttgcagaggtactatagtaaagtaaaaggttaggataagggtcctggaatccagataaaaaagtttattttccgtagttctggctgcctgttggttgtcttgacgaccaggcatagctgtgcctggtgagaaggctctggccaggcccaccagcaggtcagcagctcttaaggttcctgggtgctgtgggaagctgaaaggtaggcctcttccaggtagctcctcctctcacctccggcattgccatcagcgcagtctgccctcggtctgtgtgaagtcttaaaccaactggaagacacttgaaagggtggggagggagggaggtgccaagagtggaggcaccaaggaatgggtgatgctgccaagctgaagggtctgctttgtggagaggctgctgctctgtctgacttccagggtctcagccagccctcctgggaatagaccaagttttcagcctggcagtgccttctgttcccattttggaggacagacaagcttgctccacatctcctggctcctcccttctgagtctcatgaaatagaatgagtcagctctgctcatggaacagtagtatctcttgaggccagagcaggtcttgtattttgtttttttatttccagacttctttcggggaggttttataaaatgacagtggtgttcccagcatatgtgatatgtggttagacttctgatagtatcagcttccaggggctaatctggcttatgttgggaggatatgcttacgaatcagcagcagctttctaaaggagagatttgacttttctctgcactgcacagcctggaggattggcttttgatggggatttgcctccgaagctctttgtacatttcttgtttaggagggttttcctatctacctttctactgaagtagtttctggaactttcctggtggatcagagttacgtaatgcagtctgagccttcagactgctagttagaattgttttaggtgttcagaaagggcaaaataggctgatgtggcctgtcagagtgatgtgttctcaaaaaagttcacttgcacatctgtgggctgcttttgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctttagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatgtggttctggagctgcccagagctgtgcttagtagagtgtgtcttggaaacatgcccctgggcacactgtatctgctacattagtgggctatctcttatctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaattgcaaggcatactttctctgaaagtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccagagggcctgcccctcctgcttctgttcctttgccttgcagtctcctggagagagcctctcttttcctgtacagcctttgggccaaaatgcccttctagcttctccaaagaagatccgagtttatttcattctatgttttaagaggtaaaaggacataacaagtgaaagaagttttgggctaaagtaggctatgtctccttatgtattactcaatactgttttgcagagaaaacatttttcaagcatgtgcttcctgaagacacctcagtctttgggccatttgatttccaatacatagggtggaagaatgtgattttggggctgaccataaactggaaatttgtgaaatggcagtgattgggcaatcttcagtttattttttcagttgaagtggaactcatttctggaatggatttaataggctgtgtctaatgtacaaactgggtgagtcctgccttagtgtgtcctgccccaccggtacgcttccaggatactcttttcccctctgtaaagtcactttcttctgatggccagtgtcactatgatgtcagtgaggtctggggatgaggacagtgtgtcctgaaattcacaggactgactcctcaccccagtgcacgaggattcctgtggcatcaggtgctgctgtacctggtgtaggagcctaatcattgaaccattgtgttactcacattccatgtcacagaacatatcagcctcaagaaggatttggtggaggtggatttaccactggttttacaaaggaccgtgtaaagtcattgaagttgtgaaagtctattttttttcctgtaaatctattttttacagaatataagaaacatcaatgacctgatctgtccttcctcctccttcccgcttcccccaaaatcacattccagtttttattgtctttgtgtccaaagtaaactaggtgacttatttgtataaaatgttattttgccacatgagacagtaataaaagaaagattttcacagtaaaaaaaaaaaaaaaaaaaaaaaaaaaaaaaaaaaaaaaaaacaaaaaaaacaaacacaaaaaaaaaaaaaaaaaaaaaaaaaaaacatgcggttgggggggggcccccgccccccagaaaagaggttgctgctacacaccaccaacgtggtggggggccggccgcccccacagtatataatgagaccaacgcacgagcaggagaggtgcgttcaccggagaaacagacccggggggcaaacagacaggcgggggcgcgggccgccccccgaaaaaaaaagacgcgcgcggggggagacacagcaggtgtgggtaacacccccacccaggaggggtgcgtcagaagcctagcgggggactacaagaggcgccagggggccggaaaaaacg

SEQ ID NO: 426249 - DNA, 3682 bp, Homo sapiens
  misc_feature (3488)..(3488): n is a, c, g, or t
gctgggcccggggggctggtggctggcaaggaggagaagaagaaggcgggcggcggcgtcctgaaccgcctgaaggcgcggcggcaggcgccccaccacgcggccgacgacggcgtcggggcagcggtcacggagcaggagctgctggcgatggacaccatccggcccgagcacgtcctgcgcctcagccgggtcaccgagagagtgtgcactcacctagttaggcctatcttggcctgcccatcactcctggcgtgcagtctcctaaccctgtggcagcagcaacattccctggatggatcgaaggctgccatggtgtctgctgagctgctatagcaggcagcccagggctgttcagattatttatgtaaacccgaagacaacatctacagtattgatttcacccgcttcaaaattcgagatttggagacagggacagtactttttgagattgccaaaccttgcgtttcagaccaggaggaggatgaggaggagggaggtggagacgtggacatcagcgcaggacgttttgtccgctatcagttcacaccggcatttctccgcctccggacagtcggggctacggtggagttcacagtgggagacaaacctgtttcaaacttccggatgatcgaacggcactatttccgggaacacttgctgaaaaactttgactttgattttggcttctgcatccccagcagtaggaacacttgtgaacatatctatgagtttccccagctttcggaggatgtcattcgtctaatgattgaaaatccttacgagacccgctctgacagcttctactttgttgacaacaagctgataatgcacaacaaggctgattatgcctataatggaggccagtaagtgctgcaagagtaggtaggggaggtgctttgccgcggccacaagatcctggcacacggagatgatcgaagctgcagtttgtcaacacacatctggaacctggccccaggaagccaaggctggggtggcagtttcctgcgcgccaaaggagctgccaaacagtgctgtgttttcttccccagtattttttcttccctttttttcctgccccgtaggttgcagaggtactatagtaaagtaaaaggttaggataagggtcctggaatccagataaaaaagtttattttccgtagttctggctgcctgttggttgtcttgacgaccaggcatagctgtgcctggtgagaaggctctggccaggcccaccagcaggtcagcagctcttaaggttcctgggtgctgtgggaagctgaaaggtaggcctcttccaggtagctcctcctctcacctccggcattgccatcagcgcagtctgccctcggtctgtgtgaagtcttaaaccaactggaagacacttgaaagggtggggagggagggaggtgccaagagtggaggcaccaaggaatgggtgatgctgccaagctgaagggtctgctttgtggagaggctgctgctctgtctgacttccagggtctcagccagccctcctgggaatagaccaagttttcagcctggcagtgccttctgttcccattttggaggacagacaagcttgctccacatctcctggctcctcccttctgagtctcatgaaatagaatgagtcagctctgctcatggaacagtagtatctcttgaggccagagcaggtcttgtattttgtttttttatttccagacttctttcggggaggttttataaaatgacagtggtgttcccagcatatgtgatatgtggttagacttctgatagtatcagcttccaggggctaatctggcttatgttgggaggatatgcttacgaatcagcagcagctttctaaaggagagatttgacttttctctgcactgcacagcctggaggattggcttttgatggggatttgcctccgaagctctttgtacatttcttgtttaggagggttttcctatctacctttctactgaagtagtttctggaactttcctggtggatcagagttacgtaatgcagtctgagccttcagactgctagttagaattgttttaggtgttcagaaagggcaaaataggctgatgtggcctgtcagagtgatgtgttctcaaaaaagttcacttgcacatctgtgggctgcttttgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctttagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatgtggttctggagctgcccagagctgtgcttagtagagtgtgtcttggaaacatgcccctgggcacactgtatctgctacattagtgggctatctcttatctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaattgcaaggcatactttctctgaaagtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccaaggcngccctctggtgattgtccttggctgcagctcaggagaagcccactttcggaagctgggcaaaagccttaagtctccaagagaccggattcactggtcacagacggaccacggggcggcggcaaggaggcatgtacaagggggagactaaggttgcggccctgtgcggcacagggacgtcgggcacgatgagtga

SEQ ID NO: 426250 - DNA, 3039 bp, Homo sapiens
gctgggcccggggggctggtggctggcaaggaggagaagaagaaggcgggcggcggcgtcctgaaccgcctgaaggcgcggcggcaggcgccccaccacgcggccgacgacggcgtcggggcagcggtcacggagcaggagctgctggcgatggacaccatccggcccgagcacgtcctgcgcctcagccgggtcaccgagagagtgtgcactcacctagttaggcctatcttggcctgcccatcactcctggcgtgcagtctcctaaccctgtggcagcagcaacattccctggatggatcgaaggctgccatggtgtctgctgagctgctatagcaggcagcccagggctgttcagattatttatgtaaacccgaagacaacatctacagtattgatttcacccgcttcaaaattcgagatttggagacagggacagtactttttgagattgccaaaccttgcgtttcagaccaggaggaggatgaggaggagggaggtggagacgtggacatcagcgcaggacgttttgtccgctatcagttcacaccggcatttctccgcctccggacagtcggggctacggtggagttcacagtgggagacaaacctgtttcaaacttccggatgatcgaacggcactatttccgggaacacttgctgaaaaactttgactttgattttggcttctgcatccccagcagtaggaacacttgtgaacatatctatgagtttccccagctttcggaggatgtcattcgtctaatgattgaaaatccttacgagacccgctctgacagcttctactttgttgacaacaagctgataatgcacaacaaggctgattatgcctataatggaggccagtaagtgctgcaagagtaggtaggggaggtgctttgccgcggccacaagatcctggcacacggagatgatcgaagctgcagtttgtcaacacacatctggaacctggccccaggaagccaaggctggggtggcagtttcctgcgcgccaaaggagctgccaaacagtgctgtgttttcttccccagtattttttcttccctttttttcctgccccgtaggttgcagaggtactatagtaaagtaaaaggttaggataagggtcctggaatccagataaaaaagtttattttccgtagttctggctgcctgttggttgtcttgacgaccaggcatagctgtgcctggtgagaaggctctggccaggcccaccagcaggtcagcagctcttaaggttcctgggtgctgtgggaagctgaaaggtaggcctcttccaggtagctcctcctctcacctccggcattgccatcagcgcagtctgccctcggtctgtgtgaagtcttaaaccaactggaagacacttgaaagggtggggagggagggaggtgccaagagtggaggcaccaaggaatgggtgatgctgccaagctgaagggtctgctttgtggagaggctgctgctctgtctgacttccagggtctcagccagccctcctgggaatagaccaagttttcagcctggcagtgccttctgttcccattttggaggacagacaagcttgctccacatctcctggctcctcccttctgagtctcatgaaatagaatgagtcagctctgctcatggaacagtagtatctcttgaggccagagcaggtcttgtattttgtttttttatttccagacttctttcggggaggttttataaaatgacagtggtgttcccagcatatgtgatatgtggttagacttctgatagtatcagcttccaggggctaatctggcttatgttgggaggatatgcttacgaatcagcagcagctttctaaaggagagatttgacttttctctgcactgcacagcctggaggattggcttttgatggggatttgcctccgaagctctttgtacatttcttgtttaggagggttttcctatctacctttctactgaagtagtttctggaactttcctggtggatcagagttacgtaatgcagtctgagccttcagactgctagttagaattgttttaggtgttcagaaagggcaaaataggctgatgtggcctgtcagagtgatgtgttctcaaaaaagttcacttgcacatctgtgggctgcttttgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctttagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgagaattatttatgtaaacccgaagacaacatctacagtattgatttcacccgcttcaaaattcgagatttggagacagggacagtacttttttgagattgccaaaccttgcggtttcagaccaggaggaggatgaggaggaggggaggtggagacgtggaca

SEQ ID NO: 426251 - DNA, 4478 bp, Homo sapiens
gctgggcccggggggctggtggctggcaaggaggagaagaagaaggcgggcggcggcgtcctgaaccgcctgaaggcgcggcggcaggcgccccaccacgcggccgacgacggcgtcggggcagcggtcacggagcaggagctgctggcgatggacaccatccggcccgagcacgtcctgcgcctcagccgggtcaccgagagagtgtgcactcacctagttaggcctatcttggcctgcccatcactcctggcgtgcagtctcctaaccctgtggcagcagcaacattccctggatggatcgaaggctgccatggtgtctgctgagctgctatagcaggcagcccagggctgttcagattatttatgtaaacccgaagacaacatctacagtattgatttcacccgcttcaaaattcgagatttggagacagggacagtactttttgagattgccaaaccttgcgtttcagaccaggaggaggatgaggaggagggaggtggagacgtggacatcagcgcaggacgttttgtccgctatcagttcacaccggcatttctccgcctccggacagtcggggctacggtggagttcacagtgggagacaaacctgtttcaaacttccggatgatcgaacggcactatttccgggaacacttgctgaaaaactttgactttgattttggcttctgcatccccagcagtaggaacacttgtgaacatatctatgagtttccccagctttcggaggatgtcattcgtctaatgattgaaaatccttacgagacccgctctgacagcttctactttgttgacaacaagctgataatgcacaacaaggctgattatgcctataatggaggccagtaagtgctgcaagagtaggtaggggaggtgctttgccgcggccacaagatcctggcacacggagatgatcgaagctgcagtttgtcaacacacatctggaacctggccccaggaagccaaggctggggtggcagtttcctgcgcgccaaaggagctgccaaacagtgctgtgttttcttccccagtattttttcttccctttttttcctgccccgtaggttgcagaggtactatagtaaagtaaaaggttaggataagggtcctggaatccagataaaaaagtttattttccgtagttctggctgcctgttggttgtcttgacgaccaggcatagctgtgcctggtgagaaggctctggccaggcccaccagcaggtcagcagctcttaaggttcctgggtgctgtgggaagctgaaaggtaggcctcttccaggtagctcctcctctcacctccggcattgccatcagcgcagtctgccctcggtctgtgtgaagtcttaaaccaactggaagacacttgaaagggtggggagggagggaggtgccaagagtggaggcaccaaggaatgggtgatgctgccaagctgaagggtctgctttgtggagaggctgctgctctgtctgacttccagggtctcagccagccctcctgggaatagaccaagttttcagcctggcagtgccttctgttcccattttggaggacagacaagcttgctccacatctcctggctcctcccttctgagtctcatgaaatagaatgagtcagctctgctcatggaacagtagtatctcttgaggccagagcaggtcttgtattttgtttttttatttccagacttctttcggggaggttttataaaatgacagtggtgttcccagcatatgtgatatgtggttagacttctgatagtatcagcttccaggggctaatctggcttatgttgggaggatatgcttacgaatcagcagcagctttctaaaggagagatttgacttttctctgcactgcacagcctggaggattggcttttgatggggatttgcctccgaagctctttgtacatttcttgtttaggagggttttcctatctacctttctactgaagtagtttctggaactttcctggtggatcagagttacgtaatgcagtctgagccttcagactgctagttagaattgttttaggtgttcagaaagggcaaaataggctgatgtggcctgtcagagtgatgtgttctcaaaaaagttcacttgcacatctgtgggctgcttttgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctttagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatgtggttctggagctgcccagagctgtgcttagtagagtgtgtcttggaaacatgcccctgggcacactgtatctgctacattagtgggctatctcttatctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaattgcaaggcatactttctctgaaagtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccagagggcctgcccctcctgcttctgttcctttgccttgcagtctcctggagagagcctctcttttcctgtacagcctttgggccaaaatgcccttctagcttctccaaagaagatccgagtttatttcattctatgttttaagaggtaaaaggacataacaagtgaaagaagttttgggctaaagtaggctatgtctccttatgtattactcaatactgttttgcagagaaaacatttttcaagcatgtgcttcctgaagacacctcagtctttgggccatttgatttccaatacatagggtggaagaatgtgattttggggctgaccataaactggaaatttgtgaaatggcagtgattgggcaatcttcagtttattttttcagttgaagtggaactcatttctggaatggatttaataggctgtgtctaatgtacaaactgggtgagtcctgccttagtgtgtcctgccccaccggtacgcttccaggatactcttttcccctctgtaaagtcactttcttctgatggccagtgtcactatgatgtcagtgaggtctggggatgaggacagtgtgtcctgaaattcacaggactgactcctcaccccagtgcacgaggattcctgtggcatcaggtgctgctgtacctggtgtaggagcctaatcattgaaccattgtgttactcacattccatgtcacagaacatatcagcctcaagaaggatttggtggaggtggatttaccactggttttacaaaggaccgtgtaaagtcattgaagttgtgaaagtctattttttttcctgtaaatctattttttacagaatataagaaacatcaatgacctgatctgtccttcctcctccttcccgcttcccccaaaatcacattccagtttttattgtctttgtgtccaaagtaaactaggtgacttatttgtataaaatgttattttgccacatgagacagtaataaaagaaagattttcacagta

SEQ ID NO: 426252 - DNA, 3402 bp, Homo sapiens
gctgggcccggggggctggtggctggcaaggaggagaagaagaaggcgggcggcggcgtcctgaaccgcctgaaggcgcggcggcaggcgccccaccacgcggccgacgacggcgtcggggcagcggtcacggagcaggagctgctggcgatggacaccatccggcccgagcacgtcctgcgcctcagccgggtcaccgagagagtgtgcactcacctagttaggcctatcttggcctgcccatcactcctggcgtgcagtctcctaaccctgtggcagcagcaacattccctggatggatcgaaggctgccatggtgtctgctgagctgctatagcaggcagcccagggctgttcagattatttatgtaaacccgaagacaacatctacagtattgatttcacccgcttcaaaattcgagatttggagacagggacagtactttttgagattgccaaaccttgcgtttcagaccaggaggaggatgaggaggagggaggtggagacgtggacatcagcgcaggacgttttgtccgctatcagttcacaccggcatttctccgcctccggacagtcggggctacggtggagttcacagtgggagacaaacctgtttcaaacttccggatgatcgaacggcactatttccgggaacacttgctgaaaaactttgactttgattttggcttctgcatccccagcagtaggaacacttgtgaacatatctatgagtttccccagctttcggaggatgtcattcgtctaatgattgaaaatccttacgagacccgctctgacagcttctactttgttgacaacaagctgataatgcacaacaaggctgattatgcctataatggaggccagtaagtgctgcaagagtaggtaggggaggtgctttgccgcggccacaagatcctggcacacggagatgatcgaagctgcagtttgtcaacacacatctggaacctggccccaggaagccaaggctggggtggcagtttcctgcgcgccaaaggagctgccaaacagtgctgtgttttcttccccagtattttttcttccctttttttcctgccccgtaggttgcagaggtactatagtaaagtaaaaggttaggataagggtcctggaatccagataaaaaagtttattttccgtagttctggctgcctgttggttgtcttgacgaccaggcatagctgtgcctggtgagaaggctctggccaggcccaccagcaggtcagcagctcttaaggttcctgggtgctgtgggaagctgaaaggtaggcctcttccaggtagctcctcctctcacctccggcattgccatcagcgcagtctgccctcggtctgtgtgaagtcttaaaccaactggaagacacttgaaagggtggggagggagggaggtgccaagagtggaggcaccaaggaatgggtgatgctgccaagctgaagggtctgctttgtggagaggctgctgctctgtctgacttccagggtctcagccagccctcctgggaatagaccaagttttcagcctggcagtgccttctgttcccattttggaggacagacaagcttgctccacatctcctggctcctcccttctgagtctcatgaaatagaatgagtcagctctgctcatggaacagtagtatctcttgaggccagagcaggtcttgtattttgtttttttatttccagacttctttcggggaggttttataaaatgacagtggtgttcccagcatatgtgatatgtggttagacttctgatagtatcagcttccaggggctaatctggcttatgttgggaggatatgcttacgaatcagcagcagctttctaaaggagagatttgacttttctctgcactgcacagcctggaggattggcttttgatggggatttgcctccgaagctctttgtacatttcttgtttaggagggttttcctatctacctttctactgaagtagtttctggaactttcctggtggatcagagttacgtaatgcagtctgagccttcagactgctagttagaattgttttaggtgttcagaaagggcaaaataggctgatgtggcctgtcagagtgatgtgttctcaaaaaagttcacttgcacatctgtgggctgcttttgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctttagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatgtggttctggagctgcccagagctgtgcttagtagagtgtgtcttggaaacatgcccctgggcacactgtatctgctacattagtgggctatctcttatctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaatttggcagaggtcattactttggcttcgtggaagacgttatagcaggagagccaatgtctacgggcctgggccagtggtcttatttcccccgcgaaatcctggaaaacttggttt

SEQ ID NO: 426253 - DNA, 854 bp, Homo sapiens
gctgggcccggggggctggtggctggcaaggaggagaagaagaaggcgggcggcggcgtcctgaaccgcctgaaggcgcggcggcaggcgccccaccacgcggccgacgacggcgtcggggcagcggtcacggagcaggagctgctggcgatggacaccatccggcccgagcacgtcctgcgcctcagccgggtcaccgagagagtgtgcactcacctagttaggcctatcttggcctgcccatcactcctggcgtgcagtctcctaaccctgtggcagcagcaacattccctggatggatcgaaggctgccatggtgtctgctgagctgctatagcaggcagcccagggctgttcagattatttatgtaaacccgaagacaacatctacagtattgatttcacccgcttcaaaattcgagatttggagacagggacagtactttttgagattgccaaaccttgcgtttcaggtaggcctctacgttgtggtgaccactagacagttttgagccaaaggtctttgaaactcaaatctttgtgtgccactgcatcctgtttcttggactccagtgtgtcccacttctgtgacctcttcccgtggcctggtctgccaggcatggtggtttgaagctgcgttcagaggctgatgtttgttggatgtctattctgtgctggtcactgtgttccacgtctttgtgcacatcagtgtatgtaatcctcacacctctttgaggaattactgttatctctgttttacagcgaaggatctgaggcctacaattcccaggcggctctttcctaaggccctgtgctggttcatcttaccatgttgcctttcagagaagaaatcct

SEQ ID NO: 426254 - DNA, 918 bp, Homo sapiens
ggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtga

SEQ ID NO: 426255 - DNA, 1219 bp, Homo sapiens
ggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaacaacaaaaaaaaaaacaaaacaaaaaaaaaaacaccccgggggccttcttttgcgcggggcgccgggaaacgcggggttaggaagggcgcccgggcgccaggggtttcctctggccccgcggttttttcttgttcaccaaagcggtgggacaactctcggcgcgcgggcccccccccttatggggggcgcgcgcggtatataatttccgaaagaccccgggtgtactctgttttattgtctctctgcgaaagacatgcccctttccccgccacccgctctttttgcactcagt

SEQ ID NO: 426256 - DNA, 883 bp, Homo sapiens
gatggtagccggtgcagcgggggcctgggccctggtggccctgatggaaccgcggtccgcgggtcggtggtggccggtcgcgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtga

SEQ ID NO: 426257 - DNA, 1287 bp, Homo sapiens
ggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacataagctttaatcaggaaaatagtgattagccgtaaaaaaaaaaacaaaggggtactgccattgccttaatggccataaataaatgcgcggttaacgtcgattggaacctggttcccactaaggcttggaataccttttcaatgggaaaatgagggcccactggcttccaaattgcactcaggcatggaattggctaattttgtaaccgcaaatttaaaaatcttttacaatggccaagcaacctttaaaaaataccccctatgtggtttccttaaaagcctttagaggttcaccatggcaaccttttgggggcccgtgcacctataattttgcgggtacaattctctagtccctaaattttctcaccccttccgacagcttctgtcgacgctttacacctgttatctgcc

SEQ ID NO: 426258 - DNA, 735 bp, Homo sapiens
gatggtagccggtgcagcgggggcctgggccctggtggccctgatggaaccgcggtccgcgggtcggtggtggccggtcgcgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgaatagcgaggtgccgatgaatagcgaggtgccgatgaatagcgaggtgccgatgaatagcgtggcgccgaaaaatagcgctgtgcctattaatagcgtggcgcctatgtat

SEQ ID NO: 426259 - DNA, 1687 bp, Homo sapiens
tcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426260 - DNA, 1455 bp, Homo sapiens
tcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426261 - DNA, 1637 bp, Homo sapiens
cctccccctagggctcctacctcacagcgctcacccaggacagaggaccagagtctgcaccccctccagggcagctccaaccccatatccccaggccctgggttgaggggtgctggcggtggggaggcagggacagtaggctccctacccccgccgccgccgcctcttcttccaccactgccaccgcctcctcttcatctgcggcccaccggcgtgcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426262 - DNA, 1951 bp, Homo sapiens
cctccccctagggctcctacctcacagcgctcacccaggacagaggaccagagtctgcaccccctccagggcagctccaaccccatatccccaggccctgggttgaggggtgctggcggtggggaggcagggacagtaggctccctacccccgccgccgccgcctcttcttccaccactgccaccgcctcctcttcatctgcggcccaccggcgtgcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtgaagtagtatttgaagcttttcatcagttggctcattctttactcaagaataaacctcaagaaacgtcatcagggtcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426263 - DNA, 1398 bp, Homo sapiens
cctccccctagggctcctacctcacagcgctcacccaggacagaggaccagagtctgcaccccctccagggcagctccaaccccatatccccaggccctgggttgaggggtgctggcggtggggaggcagggacagtagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426264 - DNA, 1478 bp, Homo sapiens
cctccccctagggctcctacctcacagcgctcacccaggacagaggaccagagtctgcaccccctccagggcagctccaaccccatatccccaggccctgggttgaggggtgctggcggtggggaggcagggacagtaggctccctacccccgccgccgccgcctcttcttccaccactgccaccgcctcctcttcatctgcggcccaccggcgtgcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaactcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426265 - DNA, 1710 bp, Homo sapiens
cctccccctagggctcctacctcacagcgctcacccaggacagaggaccagagtctgcaccccctccagggcagctccaaccccatatccccaggccctgggttgaggggtgctggcggtggggaggcagggacagtaggctccctacccccgccgccgccgcctcttcttccaccactgccaccgcctcctcttcatctgcggcccaccggcgtgcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426266 - DNA, 1157 bp, Homo sapiens
gcctcacggaagtggctcgcgcgtccaagaggggaggcctggtgtggggacgctcagctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426267 - DNA, 1735 bp, Homo sapiens
tcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaaacaaaaaaaaagtcgacgcggccgcgaatttagtagtagtagtcgacc

SEQ ID NO: 426268 - DNA, 1403 bp, Homo sapiens
tcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426269 - DNA, 1677 bp, Homo sapiens
  misc_feature (1074)..(1074): n is a, c, g, or t
  misc_feature (1076)..(1076): n is a, c, g, or t
  misc_feature (1089)..(1089): n is a, c, g, or t
  misc_feature (1110)..(1110): n is a, c, g, or t
  misc_feature (1150)..(1150): n is a, c, g, or t
  misc_feature (1154)..(1154): n is a, c, g, or t
  misc_feature (1159)..(1159): n is a, c, g, or t
  misc_feature (1166)..(1167): n is a, c, g, or t
  misc_feature (1173)..(1173): n is a, c, g, or t
tcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggacncnagcgccgcccccnccaaccccccccccccccccnccccgccgacccccccccccccccccgcccccggcagccnccgnggccnccccaannccatgnccccccccccgcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426270 - DNA, 1625 bp, Homo sapiens
agcggggctggctggggaacgttgacccacaccaggtcccgtacaggaacggagactccctaggaccgtgagagccagcttcgtaattctcttgctcttcaaacctgagagtagggtgttgctccgttaccttccattcgtgtgcaggagagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtgaagtagtatttgaagcttttcatcagttggctcattctttactcaagaataaacctcaagaaacgtcatcagggtcagaatgacaacggcaacacgacaagaagtccttggcctctaccgcagcattttcaggcttgcgaggaaatggcaggcgacatcagggcagatgaaaaacagtacatactaaatgaagccagaacgctgttccggaaaaacaaaaatctcacggacacagacctaattaaacagtgccaggattgaaattggactgcattacaagattccttacccaaggccaattcatctgcctccaatgggccttaccccactccgagccaagagaaactgaggaaactttccaaaccagtatatctcagatctcatgatgaagtttcctaatctagaggaaagtttatttctgcaattgaatgtaaaccagatggcaaaacacttcttgattaggggcaaaaattcaaatgtcttcttaaaacctccacaattgattctccccctgtgatagtttctcagcatctttcttcctgagtggatggcattatccctagaggtcatggaccttacatcctcactgcagtcacctttggaaacaagaccgaggcctgtagaaggaaagcggatgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426271 - DNA, 1869 bp, Homo sapiens
cctccccctagggctcctacctcacagcgctcacccaggacagaggaccagagtctgcaccccctccagggcagctccaaccccatatccccaggccctgggttgaggggtgctggcggtggggaggcagggacagtaggctccctacccccgccgccgccgcctcttcttccaccactgccaccgcctcctcttcatctgcggcccaccggcgtgcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426272 - DNA, 1726 bp, Homo sapiens
agcggggctggctggggaacgttgacccacaccaggtcccgtacaggaacggagactccctaggaccgtgagagccagcttcgtaattctcttgctcttcaaacctgagagtagggtgttgctccgttaccttccattcgtgtgcaggagagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtgaagtagtatttgaagcttttcatcagttggctcattctttactcaagaataaacctcaagaaacgtcatcagggtcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426273 - DNA, 1695 bp, Homo sapiens
gcctcacggaagtggctcgcgcgtccaagaggggaggcctggtgtggggacgctcaggtgccggcgtggggccccctcggaggctgtgaatcttttggacccccgaatgtaaatgggagatgagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtgaagtagtatttgaagcttttcatcagttggctcattctttactcaagaataaacctcaagaaacgtcatcagggtcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426274 - DNA, 2342 bp, Homo sapiens
tcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaaaaaaaaaaaaaaaaaaaaaaaaaaaaaaaaaaaaaaaaaaaaaaaaaaaaaaaaaagaaaagagaaaaaaaaacaagagaagaaagaacaaaagaaaacataaaaaaaaaaggaacagacaagaggaatacagcaaacaggacaagaagaagccgacacgcgggcgggcggcgcccgacgacgcgccacgacggccagaggaggagggggagggcgagtgagaaggagagcagctaaagttctagggtggagcgaagaagaagaggagaacgcgcgtcagcgcgagggagtgggggaatgatgaggcggtgaggaccggggcgcagacaggggtggggaggtacagagaggagggaagagcaagaaccacagacgaggagaatgtgtgatgcacggacgcacgggagcgcgagtaaacacaatatcagtagtctgcctgaggggggacgagacgagatgagacggcggagggaggagctaaaagcagcgaaaccggccgacagcaggagcagcgctaccagtggccgccaagcgcacccagaaagaagggggagagatcacaaggcggagcggatgacagagagcatgggatgatcgtagaaagcgagagcgggcaagcaagacaaacggcgatgaggtaaagaacgacgcggac

SEQ ID NO: 426275 - DNA, 1296 bp, Homo sapiens
tcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagactcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426276 - DNA, 1681 bp, Homo sapiens
agcggggctggctggggaacgttgacccacaccaggtcccgtacaggaacggagactccctaggaccgtgagagccagcttcgtaattctcttgctcttcaaacctgagagtagggtgttgctccgttaccttccattcgtgtgcaggagagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtgaagtagtatttgaagcttttcatcagttggctcattctttactcaagaataaacctcaagaaacgtcatcagggtcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatgccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426277 - DNA, 1585 bp, Homo sapiens
cctccccctagggctcctacctcacagcgctcacccaggacagaggaccagagtctgcaccccctccagggcagctccaaccccatatccccaggccctgggttgaggggtgctggcggtggggaggcagggacagtaggctccctacccccgccgccgccgcctcttcttccaccactgccaccgcctcctcttcatctgcggcccaccggcgtgcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 426278 - DNA, 1069 bp, Homo sapiens
cctccccctagggctcctacctcacagcgctcacccaggacagaggaccagagtctgcaccccctccagggcagctccaaccccatatccccaggccctgggttgaggggtgctggcggtggggaggcagggacagtaggctccctacccccgccgccgccgcctcttcttccaccactgccaccgcctcctcttcatctgcggcccaccggcgtgcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaactgttattggttcatcaccaccattgcactgttcattgcctcctgg

SEQ ID NO: 426279 - DNA, 3443 bp, Homo sapiens
agggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgccctatagtctcagctacttgtgaggctgaggcaggaggattctttgagccccaggagtttgaggttacagtgagccacaatcacacccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgtttttagcta

SEQ ID NO: 426280 - DNA, 3449 bp, Homo sapiens
agggagggagaatccggccggacagatctgcgcgtatcctggagccggcccagttgtgaactaggagagctttgggacctctgtcccaagcaagtaagaactttagccttaggagatgtaaataaagtagtatttgaagaagcacaggagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgccctatagtctcagctacttgtgaggctgaggcaggaggattctttgagccccaggagtttgaggttacagtgagccacaatcacacccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgtttttagcta

SEQ ID NO: 426281 - DNA, 3096 bp, Homo sapiens
  misc_feature (2991)..(2991): n is a, c, g, or t
  misc_feature (2993)..(2993): n is a, c, g, or t
  misc_feature (3020)..(3020): n is a, c, g, or t
  misc_feature (3022)..(3022): n is a, c, g, or t
agggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaattagtttattatatttaatgcttntntcctattataatacttttgggacatcntntttcagagaacagtatttgactgtgtgtgtgtgtgtgtgtgtgtgtgtgtgtgtgtctgtctgtctgtgcgtgc

SEQ ID NO: 426282 - DNA, 3096 bp, Homo sapiens
  misc_feature (2991)..(2991): n is a, c, g, or t
  misc_feature (2993)..(2993): n is a, c, g, or t
  misc_feature (3020)..(3020): n is a, c, g, or t
  misc_feature (3022)..(3022): n is a, c, g, or t
agggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaaatggggtcttgctatgttgcccaaggttggtctcgaaccctggcctcaaggaatcctctcacctcagcctcctgagtcactgtgattacagtgtgagctactgcatctggagactttatcacttcttaaattagtttattatatttaatgcttntntcctattataatacttttgggacatcntntttcagagaacagtatttgactgtgtgtgtgtgtgtgtgtgtgtgtgtgtgtgtgtctgtctgtctgtgcgtgc

SEQ ID NO: 426283 - DNA, 3421 bp, Homo sapiens
agggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgccctatagtctcagctacttgtgaggctgaggcaggaggattctttgagccccaggagtttgaggttacagtgagccacaatcacacccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgtttttagcta

SEQ ID NO: 426284 - DNA, 2013 bp, Homo sapiens
ctgaggctcagagaggtctgagagccacacagctggtgcatggtggagccacgatttaaacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgccctatagtctcagctacttgtgaggctgaggcaggaggattctttgagccccaggagtttgaggttacagtgagccacaatcacacccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgtttttagcta

SEQ ID NO: 426285 - DNA, 987 bp, Homo sapiens
taccattctgatgttggcgcggactgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaat

SEQ ID NO: 426286 - DNA, 1073 bp, Homo sapiens
tccctgtatagctccagtcctgttcatgttctctctcaccagcagtacatctgtgctgtgaggatgttaaggggatgagtgaagaggggtttaccctgactccttcacagcttgattgcacattgatccaaccctcctaacaactagatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaat

SEQ ID NO: 426287 - DNA, 564 bp, Homo sapiens
gcggaggccggcgcggagctgcagttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaaga

SEQ ID NO: 426288 - DNA, 1229 bp, Homo sapiens
taccattctgatgttggcgcggactgtctgggctgctgcgcgccgcctaggtgtctgggcgatctatgggcaagagcaagggccacgatgacagattacggcgaggagcagcgcaacgagctggaggccctggagtccatctaccctgactccttcacaggcagatgtctctcagctatccctgtatagctccagtcctgttcatgttctctctcaccagcagtacatctgtgctgtgaggatgttaaggggatgagtgaagaggggtttgagagtgtcattaactggcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaat

SEQ ID NO: 426289 - DNA, 1213 bp, Homo sapiens
gcggaggccggcgcggagctgcagttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacaggcagatgtctctcagctatccctgtatagctccagtcctgttcatgttctctctcaccagcagtacatctgtgctgtgaggatgttaaggggatgagtgaagaggggtttgagagtgtcattaactggtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaat

SEQ ID NO: 426290 - DNA, 898 bp, Homo sapiens
tagaggatcgcgcgtactccgtacagatcataatcttgcagatctgatatcagttcttggaggatgtggaaacaacgtggaggtagatgagtctttgtaccaagaaatggatgacttggagctagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaat

SEQ ID NO: 426291 - DNA, 820 bp, Homo sapiens
gcggaggccggcgcggagctgcagttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatggtaagataatagtagaattccacat

SEQ ID NO: 426292 - DNA, 876 bp, Homo sapiens
  misc_feature (772)..(772): n is a, c, g, or t
  misc_feature (785)..(785): n is a, c, g, or t
  misc_feature (802)..(802): n is a, c, g, or t
  misc_feature (855)..(855): n is a, c, g, or t
  misc_feature (869)..(869): n is a, c, g, or t
taccattctgatgttggcgcggactgtctgggctgctgcgcgccgcctaggtgtctgggcgatctatgggcaagagcaagggccacgatgacagattacggcgaggagcagcgcaacgagctggaggccctggagtccatctaccctgactccttcacagcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaaggggtgaaaaaaaaaaaaaaaaccaccgccccggaaaaaaaaataaaaattaaaaggtggggggnaaaacaaaccttntttttggaaaaccaagnaatccaattaaattccttggggaccaccaatccttggaattatttcccccccnttcttttggggaangggaatg

SEQ ID NO: 426293 - DNA, 735 bp, Homo sapiens
taccattctgatgttggcgcggactgtctgggctgctgcgcgccgcctaggtgtctgggcgatctatgggcaagagcaagggccacgatgacagattacggcgaggagcagcgcaacgagctggaggccctggagtccatctaccctgactccttcacagcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagatataataaaaaataacctcgaattagaatcaaatatttttaatcctgtacctttgggaactttggaaactttcaatttctgagaagaaccattcccaagaggataacctggcctcaatgtttaaggtagaattaaatcaatttcatctcctttaa

SEQ ID NO: 426294 - DNA, 580 bp, Homo sapiens
taccattctgatgttggcgcggactgtctgggctgctgcgcgccgcctaggtgtctgggcgatctatgggcaagagcaagggccacgatgacagattacggcgaggagcagcgcaacgagctggaggccctggagtccatctaccctgactccttcacagcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaaga

SEQ ID NO: 426295 - DNA, 701 bp, Homo sapiens
taccattctgatgttggcgcggactgtctgggctgctgcgcgccgcctaggtgtctgggcgatctatgggcaagagcaagggccacgatgacagattacggcgaggagcagcgcaacgagctggaggccctggagtccatctaccctgactccttcacaggcagatgtctctcagctatccctgtatagctccagtcctgttcatgttctctctcaccagcagtacatctgtgctgtgaggatgttaaggggatgagtgaagaggggtttgagagtgtcattaactggcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggcctcatcccccggcgggttcacagcccttggtctggaaaaaaaaggggctgctggcatggacagttgaagattagccctcccgcccctcctgcagccctgc

SEQ ID NO: 426296 - DNA, 1085 bp, Homo sapiens
gcggaggccggcgcggagctgcagttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaat

SEQ ID NO: 426297 - DNA, 1101 bp, Homo sapiens
taccattctgatgttggcgcggactgtctgggctgctgcgcgccgcctaggtgtctgggcgatctatgggcaagagcaagggccacgatgacagattacggcgaggagcagcgcaacgagctggaggccctggagtccatctaccctgactccttcacagcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaat

SEQ ID NO: 426298 - DNA, 886 bp, Homo sapiens
  misc_feature (44)..(44): n is a, c, g, or t
cacccccacccagcacaacgccgccggaaggagaaacgaaccangtgaggggttacaggtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaat

SEQ ID NO: 426299 - DNA, 1405 bp, Homo sapiens
gcggaggccggcgcggagctgcagttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcagctgactaatggactgtccccatctgcagagaggcttgactgccacagcatctgtggctatgctcagagggttatgattttcctttctttttttctaagaaaaaattattttcaggagaatattcttctgatagctttcatcattgaacttaataaactgaccttaaaatttcaaattaaaaacacacaaacaacacgcaaccagacacaacattgtgcgagcgcccacaattggccccatcaaaaaagctttttaagaaaccaatactggtatggaacccgcctggcccccagccaggatgctcgacacatgcggccataagcagggccccaaagaagaaacccgggtgcaagaacaaccggcgtgggattccccaacagatatataaaacgcccggggggaaaccaagcagtgcttggaaacaaacccgaagcgggcgcagaggacaaaagaggatctatccacagcggcaccagcgactacgatcaaattagcc

SEQ ID NO: 426300 - DNA, 415 bp, Homo sapiens
taccattctgatgttggcgcggactgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacaatgtatatacattgtctgatgacaaggagtaactcatcttcaaagtgcaagtaagtctatttacaaccacaaaaaaggcaa

SEQ ID NO: 426301 - DNA, 686 bp, Homo sapiens
taatgtttttaaatagaaaagacctgtcaaaaactatcaaatgtgaatcaaatctccatttagtggtacatctttaaaaaatactttgtcagccgggcgcagttgttcacacctgtaatcccagcactttgggaggcccagatgggaggacagcttgaggccaagagctcaagcactcctgccacacttgtgcccctgcacccagcttgcaatagattttattctatattcaactgtgggggaagactgtattggaattgactgattccaatcgattggtgaagaatccactgataagactaaaatgtaacctcagtccaagaacagtaattttacaatgaattctaagtcttgcaggcactcaaaatatagtgctggtactcagtagagaatatactgcaataacttttaataaaaagtgacaaaataaaaatacacctactttatttaattcaagttttagattatttgtcattcatagtattttattttctatctccatatcaagaccacttacagcttaagaggcaggctaagggttgggtgcgggggctcacgcctgtaatcccagcacttagggaggccgaggcaggagaatggcatgaacccgggaggcggagcttgcagtgagctgagatcgcgccactgcactccagcctggacaacagagtgagactccgcctaaa

SEQ ID NO: 426302 - DNA, 5156 bp, Homo sapiens
  misc_feature (4213)..(4213): n is a, c, g, or t
agagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaagctcagtgtaaacaaggcacctactcatacagtggacttgagacttgtgaatcgtgtccactgggcacttatcagccaaaatttggttcccggagctgcctctcgtgtccagaaaacacctcaactgtgaaaagaggagccgtgaacatttctgcatgtggagttccttgtccagaaggaaaattctcgcgttctgggttaatgccctgtcacccatgtcctcgtgactattaccaacctaatgcagggaaggccttctgcctggcctgtcccttttatggaactaccccattcgctggttccagatccatcacagaatgttcaagttttagttcaactttctcagcggcagaggaaagtgtggtgccccctgcctctcttggacatattaaaaagaggcatgaaatcagcagtcaggttttccatgaatgcttctttaacccttgccacaatagtggaacctgccagcaacttgggcgtggttatgtttgtctctgtccacttggatatacaggcttaaagtgtgaaacagacatcgatgagtgcagcccactgccttgcctcaacaatggagtttgtaaagacctagttggggaattcatttgtgagtgcccatcaggttacacaggtcagcggtgtgaagaaaatataaatgagtgtagctccagtccttgtttaaataaaggaatctgtgttgatggtgtggctggctatcgttgcacatgtgtgaaaggatttgtaggcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaagacggtgccaatagcttcagatgcctgtgtgcagctggcttcacaggatcacactgtgaattgaacatcaatgaatgtcagtctaatccatgtagaaatcaggccacctgtgtggatgaattaaattcatacagttgtaaatgtcagccaggattttcaggcaaaaggtgtgaaacagaacagtctacaggctttaacctggattttgaagtttctggcatctatggatatgtcatgctagatggcatgctcccatctctccatgctctaacctgtaccttctggatgaaatcctctgacgacatgaactatggaacaccaatctcctatgcagttgataacggcagcgacaataccttgctcctgactgattataacggctgggttctttatgtgaatggcagggaaaagataacaaactgtccctcggtgaatgatggcagatggcatcatattgcaatcacttggacaagtgccaatggcatctggaaagtctatatcgatgggaaattatctgacggtggtgctggcctctctgttggtttgcccatacctggtatgttttaacaaaatgagtataattctgttggactctagaggtgatgctgcttaaatggacatcaggtttgctagcattgttgttcttggtttcaaacaaagattaacagctatctctctnatttcctactccctgattatcctaactgtgggttattagaagcttttttcctaagtaagctgtttgcctctctgtgtgagaaatgcctttgaagatctacattaagactaccaagaagcatgctgaattagcagctggttgctaaactgtcttctaaggagattaattactggtattttttgtttattttaaggattgttttgttttgtaatcagtatataagcaggaccactgctatccatcttttatggcccttttcaaatagatcttggcttgtcttctaaaaaatactttttaataaatatcccaggagttttagtttgaagaattgcaaactaaatttcattaggtgacccaggttctcagcattgtacatggcaataagcttgttctatctggatacatctatagaagtatatgcatatgacattattttttactttgctcatttgtttcaggtatactaaaagaaaattaaatagacaaaaatgaattaaagtattagaaactgactaatacattctagaagtaagttgtatgaaactaggatacgtatactaataaatatagcacaaaaatactaaacttcataaaaatgcggtgagatgacccttgcgaagcctcaaatacaatacttattttatttattagaaattattggccaggtacggtggctcacgcctgtaatcccagcactttggaaggctgaggagggtggatcacgaggtcaggagttggagaccgccctggacaatatggtgaagccctatctctactaaaaacgcacagaaaaattagccaggcatggtggtagatgcctgtaattccagctactcaggaggctgaggcaggagaatcgcttgaacccaggaggcgaagattgccgtgagccgagatcatgccactgcactccagcctgggcaatggagagaggctctgtctc

SEQ ID NO: 426303 - DNA, 2372 bp, Homo sapiens
agagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggtaattaaattctgtggcatcggtagttggcaagactaatctgcaaaataagaataattccagaaaagtgaggcaaactagaaacattaacttctattaatttattcatcaagtattttaggatggctaaataatttgataatgtgctgaaagatcattaaggttatatcaaattttagtaacaaataaattatttaaaattatttgccaggattcttaaaaatgacaaaaactaagaaaactaagtcacatatgctggtaaaattcaaatgttgatgtatcctaaaagagaatagtaataaagtcctaacagcaactttta

SEQ ID NO: 426304 - DNA, 4809 bp, Homo sapiens
agagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaagctcagtgtaaacaaggcacctactcatacagtggacttgagacttgtgaatcgtgtccactgggcacttatcagccaaaatttggttcccggagctgcctctcgtgtccagaaaacacctcaactgtgaaaagaggagccgtgaacatttctgcatgtggagttccttgtccagaaggaaaattctcgcgttctgggttaatgccctgtcacccatgtcctcgtgactattaccaacctaatgcagggaaggccttctgcctggcctgtcccttttatggaactaccccattcgctggttccagatccatcacagaatgttcaagttttagttcaactttctcagcggcagaggaaagtgtggtgccccctgcctctcttggacatattaaaaagaggcatgaaatcagcagtcaggttttccatgaatgcttctttaacccttgccacaatagtggaacctgccagcaacttgggcgtggttatgtttgtctctgtccacttggatatacaggcttaaagtgtgaaacagacatcgatgagtgcagcccactgccttgcctcaacaatggagtttgtaaagacctagttggggaattcatttgtgagtgcccatcaggttacacaggtcagcggtgtgaagaaaatataaatgagtgtagctccagtccttgtttaaataaaggaatctgtgttgatggtgtggctggctatcgttgcacatgtgtgaaaggatttgtaggcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaagacggtgccaatagcttcagatgcctgtgtgcagctggcttcacaggatcacactgtgaattgaacatcaatgaatgtcagtctaatccatgtagaaatcaggccacctgtgtggatgaattaaattcatacagttgtaaatgtcagccaggattttcaggcaaaaggtgtgaaacagaacagtctacaggctttaacctggattttgaagtttctggcatctatggatatgtcatgctagatggcatgctcccatctctccatgctctaacctgtaccttctggatgaaatcctctgacgacatgaactatggaacaccaatctcctatgcagttgataacggcagcgacaataccttgctcctgactgattataacggctgggttctttatgtgaatggcagggaaaagataacaaactgtccctcggtgaatgatggcagatggcatcatattgcaatcacttggacaagtgccaatggcatctggaaagtctatatcgatgggaaattatctgacggtggtgctggcctctctgttggtttgcccatacctggtggtggtgcgttagttctggggcaagagcaagacaaaaaaggagagggattcagcccagctgagtcttttgtgggctccataagccagctcaacctctgggactatgtcctgtctccacagcaggtgaagtcactggctacctcctgcccagaggaactcagtaaaggaaacgtgttagcatggcctgatttcttgtcaggaattgtggggaaagtgaagatcgattctaagagcatattttgttctgattgcccacgcttaggagggtcagtgcctcatctgagaactgcatctgaagatttaaagccaggttccaaagtcaatctgttctgtgatccaggcttccagctggtcgggaaccctgtgcagtactgtctgaatcaaggacagtggacacaaccacttcctcactgtgaacgcattagctgtggggtgccacctcctttggagaatggcttccattcagccgatgacttctatgctggcagcacagtaacctaccagtgcaacaatggctactatctattgggtgactcaaggatgttctgtacagataatgggagctggaacggcgtttcaccatcctgccttgatgtcgatgagtgtgcagttggatcagattgtagtgagcatgcttcttgcctgaacgtagatggatcctacatatgttcatgtgtcccaccgtacacaggagatgggaaaaactgtgcaggtaac

SEQ ID NO: 426305 - DNA, 3242 bp, Homo sapiens
agagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaaggtagaggcttactggacatttcaactagaagcagcccaatttttgtttcccttttgggggaaagaaagatttattttcttcacccaacactcggctcttgtctgaggcccctgtggcaaaagatagatttgcaagagaaaagcatacacatttattcaatataagttttaggtgacataggagcctccagaaatgaatcagggaaacctgtatatttttatgctaaattggataaagaagaggatagttgtggagtagaatgacctattgggaataagctaggtggagcttagcaagtcttgtttgttcagattcttcaatgtatccctgtatcttcagggctaagaatattcttttcctctgagtatagggtgggcatttctcacatgagggttttacagtctgcttcaaaggggaaggtccaagaattatttctaggttttatgatctcctaaaggaaagaaaggcagaagttcagagacactttcctgcttctatggttttctcaaatttccttcggcttgaaatattcagtatgccaaggcaaggtatgatatttaggggtagggtgttctaagccccatcacagtcctgaaatctaaatggcaaataaaatgaaacaatagtatac

SEQ ID NO: 426306 - DNA, 2545 bp, Homo sapiens
agagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtggtaaggactgttccctgtgatccaaaaatatttggtgcatactgggtcaaatgagatgggtgtagccattttacaactataaagggatattgaaat

SEQ ID NO: 426307 - DNA, 809 bp, Homo sapiens
cggagttcaggcagctgtgtgtaaaggtaggtctctacactagtcaggctaaaaatcaaattttttaatattgccatatgggtgcagtataggacaatccttctttgcaacttttgctgcaaacccatgataatatggttaggtgctaccccaatatcctctatgaggatttctggttgaaagtggtgaatttacaaaatctgattacaaaatgccagacaatgacagaagaaatacacaaataaggaaaatagtagagctgaaaatcaggtaagttttccataagactaaaatctttagggaagtcttggtctatataaagcaggtgagactgaattgattttcaaaaagaagctatcagcactttgaaacctggcatcacattccattcacaagaggacattgccattttctctgcaacaagagcagaccgctatgaaaaaggagttactgaaaacagaaaagagttcttagaagtaaaaaatgtcctatctctaagagaaggacaagggcagatgaatggaaggaatgctgttgaaaactatattagtaatttaaaagaccaaactgagagtttcctcacaatggagaactgaatgagtaaacaaagaaagtgcttgaatttcccaattgatcaaaccaaaaagatggaagttgagggatgccagtggcagaaggaaaaaccccaatgtccatttaataaggagttccagaaggagagaggagaggagatggagaaaaatttctctaccaagagaagaaaatttctctgagctagagaatggcttaatcctttagaccacaaataa

SEQ ID NO: 426308 - DNA, 599 bp, Homo sapiens
atcttatgtctacccaatggtttgtggtccggttcagagagctactgcagaggtatgcaaactgccaatttacattgtttatttactgtcttgcctgatttccttgatttaaactctagtaaaccagtcagttcttcatttctttttggatttcatagaccccatactacagaaagagaaaaattataggaaatttgaaatcagaattaccaagttcaattgaccacataattgtaaactacgccttttatagcccttttatgaacaagcaaagaaaaagtttgcctgggaagtaaatggacaggttaccccaaacctcaaatttcaagcctctaagacatgatataaaggagagtttagaataatcagagtggagactgatgcctcttggaattgtaggacttaaggaatcacacaagtatcctgcaacaagagcagttagccaacttgtaatctccagcctttacttcggctagtcgacccgttatagaaagtagagaatttgtcaaagcgagagtccaaggagcctattcaggccaatagaaagtgggcaccaccaatggaatctgaggctcccatgtcaaatacagagaagcaat

SEQ ID NO: 426309 - DNA, 326 bp, Homo sapiens
tggatctcaaaccagtttgatgggctccacagcctccattccaatcctctagaagcagcatcctccagggagtcaacactttagttacagtgttcccagggagttaatcatttgggctgtttctcttccttctccatcctcaggcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaag

SEQ ID NO: 426310 - DNA, 422 bp, Homo sapiens
taatgatgtatgccatccatctctgttttcttttttaaaatataagtgaaacaaaatatatgtggctttacccactctgacaaccagaatcttgaccatagtgttagatatagtccacttactggcatatttgccacactgacatgtttttctattaattgattaggttttagttcaactttctcagcggcagaggaaagtgtggtgccccctgcctctcttggacatattaaaaagaggcatgaaatcagcagtcaggcaagttcattttgcataaactgttctctagtggaatgcttggaaagcaatttgtcattttacacatcacacacaggaaaaggaccaggattgaaactttaagtaatcaagatgtatgaattttataaatgaataattgtatttacaatgactcctgtttagaa

SEQ ID NO: 426311 - DNA, 1434 bp, Homo sapiens
tcaggctttcatcttgcctcttttaaaataattataaatgacactggtaaaggtacatatatcaagagtaggcattaattttcaagggctaaaatgtcattaacttcggtataaaccaaactgtactagagaggaagactgtgtccctgaatgatggcagtttaagtctgagttttactgtgagttaaaaccctctgaatttccagatgataattccatttttaatccatttggaatgctgaaagctacaaaaatgtatttcctgtcagtaaacatttgttgttttatttttgtgtttaattaaaagtttatttttcccctttaaatctttgaaggaaagaaggtttttttgtttttttgtttgtttttgtcagaatagttcatggtaaactttgcaattacagatgatagtgaaaaaaaaccccagcgacgcaatcgtagccgcaggcgtcgcttcaggggtcaggcagaagatagacagccaggtaacttgagtggacctgtggacaccatcaggtcacaagcatgaaaaaaatgtcatatgtctgctttctaaatatattatacttacatgtacacatgtgtgcatatacattcaaaatttgcattgcataaattgtttattcaactaataagactactactattaagaaaatgcattcttccttcacagtgtgttagtaacttgtctaattgaactaatgttgtgtcctaattgtttacatggaaatactgttgagaagaccattttgttcacttggcagtttcttcacacttgagatggggcctgccatccgagggactgtgttgtagattgtgatcaaggttgattggcaaaactgggcagcttttgcatggtgcctgcttactatatctgaattcagcacctcatttttgtgggagttgtaatacccacaattaaaaaaaaagtataaaagagaaaaatatttgaaggtgtctttaacctaatgcgaggaatgcatgttgtttttgtttgtttattgtagtgtgatgccttttcccttacacctactaactattcaaattaataatacttacttagttttagaatgtttattttatgtagtcattaatttttagtaacttcaaagaaacttgtttgctgtgtctattattttgaacataattccatttcctgtgtacagagaatcacatgtatattcacaatgaagcaattgtgtgcaccagaaataaacccctttcaaactaatcaatttttgcattctttccaaaaccagttctttcatgtgttttccccaaataaagaatgtaaattctggcatctttactattttaaatttagtggttgtagagacatttgggaaaactggttaagagaattagttcccatccctaaaagttcatgttttaaagatagttggaaatttttagagcaattaaatattgtcaaaa

SEQ ID NO: 426312 - DNA, 978 bp, Homo sapiens
  misc_feature (934)..(934): n is a, c, g, or t
  misc_feature (944)..(945): n is a, c, g, or t
  misc_feature (953)..(953): n is a, c, g, or t
  misc_feature (966)..(966): n is a, c, g, or t
tcaggctttcatcttgcctcttttaaaataattataaatgacactggtaaaggtacatatatcaagagtaggcattaattttcaagggctaaaatgtcattaacttcggtataaaccaaactgtactagagaggaagactgtgtccctgaatgatggcagtttaagtctgagttttactgtgagttaaaaccctctgaatttccagatgataattccatttttaatccatttggaatgctgaaagctacaaaaatgtatttcctgtcagtaaacatttgttgttttatttttgtgtttaattaaaagtttatttttcccctttaaatctttgaaggaaagaaggtttttttgtttttttgtttgtttttgtcagaatagttcatggtaaactttgcaattacagatgatagtgaaaaaaaaccccagcgacgcaatcgtagccgcaggcgtcgcttcaggggtcaggcagaagatagacagccaggtaacttgagtggacctgtggacaccatcaggtcacaagcatgaaaaaaatgtcatatgtctgctttctaaatatattatacttacatgtacacatgtgtgcatatacattcaaaatttgcattgcataaattgtttattcaactaataagactactactattaagaaaatgcattcttccttcacagtgtgttagtaacttgtctaattgaactaatgttgtgtcctaattgtttacatggaaatactgttgagaagaccattttgttcacttggcagtttcttcacacttgagatggggcctgccatccgagggactgtgttgtagattgtgatcaaggttgattggcaaaactgggcagcttttgcatggtgcctgcttactatatctgaattcagcacctcatttttgtgggagttgtaatacccacaattaaaaaaaaaacctngtgcccaatnnttggcctngagggcccaattnccttatatgagt

SEQ ID NO: 426313 - DNA, 244 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaa

SEQ ID NO: 426314 - DNA, 973 bp, Homo sapiens
gcctatctaaaggaagtagaactagcgaagaaaggaacgcctacagattaagaaacagcgacgacaaataatcatataatatcgaacgagacaaccaccaaagaagtcgcatgagagttaggatagaatataagatccatctaaataaaaaatgaccaactactatactgatacaaggttctaggtcttatagcggaagaaacagaaaaacgtacaaaaacctaataaacacctccagattatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaatagatccagacagcaagatccatagcagcgtaacgtatgataaaaactgaaatcagaggcatactactagatctgagaagcctgctaggtcactgatactgtacaatccagctaatacaagatgcaaggagtaaaaatcaaaatattaaatctaacaggagtaagaagaacaatggacatatacatgtacaggtatttattaagttttattcttctacaaataatgagctggacttctaacatgacaaatggcttcccatgagtatcgtgaacattactgactaaacacaacaacacgggtctaaaaaatagaatctggggaaattcgggtaaacacgcctggattaagcggacaggggagcgcaaacgcgcacttgtcggccgtgttgttgtgtccgctgtttgttcctttgccgtccccggacggggggccatgacaccgcaaactgtttttttggggtttgcttgtgttgtttgttttgttgtgttgttcttggtgtttgtgttgtgtgtttgtg

SEQ ID NO: 426315 - DNA, 487 bp, Homo sapiens
gtaaagacccctggtgattggtcattggcaggagaagatgatcgagatcagccgacatcagcgtgacagcaggagacgcccaggaggaagaggcagaagtgtttcagggggtcgaggtcgtggtggaccacgttggtggcaaatcctccatcagttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctggtacaaattctgagctgtctaacccctctgaaacggaatctgagcgtaaagacgagctgagtgataggtcattggcaggagaagatgatcgagacagccgacatcagcgtgacagcaggagacg

SEQ ID NO: 426316 - DNA, 553 bp, Homo sapiens
catatactggaacattcagaatctacggagagagtgctgatgctgtaaaaaaaggctagaggtttcttggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggtaggtacttttactaaatgttaaataagttaataaacattatttagttacatatagcgacttaattgaaaactagtcttgtagtctgataaccttattccagttatgtgtagatttatttagatagcaatacttcttttctttttttggtgataacattttgtgtaacttgttattgtcatatgttaaaaagtaaagatgtttcttctgtacaggatgactcactaataaggcccagggtttttataagtttgtcattacagtttt

SEQ ID NO: 426317 - DNA, 418 bp, Homo sapiens
tcacaatactaaataactgccttgctgaactaatacctgaggtgttccagggatgtacatttacttttgctaattcccaggtagatgacaccgggtgaaaaatgaggttcagagaggttaagtaacttaaaagatcatgtgtctcataaatagaatagatggaaatcaaactcacatctgcctaattccaaaccttgtgttcttttagtactccctattatctttgaactaatacaaccttttagagttacgaagtgctttaatatctatgcttttataatgtttttgtgtcttgcagggatttatcaaagatgttcatgaagactcccttacagttgtttttgaaaataattggcaaccagaacgccaggttccatttaatgaagttagattaccaccaccacctgatataaaaaaa

SEQ ID NO: 426318 - DNA, 293 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaaggccatttaagcacccgtctaaaaaaaaatgagtagatcttcatagtaaggtaggatctacaagacacaaactgaagagaaaagcgaagttcagaacaaattgtagcaaatgtttaacaatttaaaggagatttgtatattattaaaattacattttttcctgtgaatta

SEQ ID NO: 426319 - DNA, 2790 bp, Homo sapiens
ctcaaggatccttatttttttaatccccccccccccccccccccgggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426320 - DNA, 2525 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctaaaaaaaaaaaaacaaaaagatattcgataactacagtacatcgcagctacaaaacgggggggctgtcataatgataattaccgccaggatggaaactatatcaatgcctacccccctatcttgtgttcgaaaaaagtggtccatatgttagacgtaactatcaactacaatctatcagtgttattacaatcatgcgtgatagaaaaagttgttatgactacttgttggagacccatccgtgtggtgggaataatggagaccacacagctatataacccgggaataaatacgacttatgagcaacctgtttgttgaaaaattattacataata

SEQ ID NO: 426321 - DNA, 2708 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426322 - DNA, 2881 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagatgatagtgaaaaaaaaccccagcgacgcaatcgtagccgcaggcgtcgcttcaggggtcaggcagaagatagacagccagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426323 - DNA, 2545 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagatgatagtgaaaaaaaaccccagcgacgcaatcgtagccgcaggcgtcgcttcaggggtcaggcagaagatagacagccagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctaaaaaaaaaaaaacaaaaaaaaaaaaacaccaaacaagaataaaaaaaacaaaacacacaacaaaacagaaaaaaacaaaacaggggggaccccacagagaaatacacaggggagccacagaaagatgcaccacaacttggacacaggggcccgcgggggggcggaaaaaaaaaccgcgcggcgaccgcattacaaagcgggtgcgacgaaaaacgcggacagggaaaatcggggagcaccccaccggggggacacacacggcaaacccagg

SEQ ID NO: 426324 - DNA, 2706 bp, Homo sapiens
gcggaccgacggctcacggaacttctacagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426325 - DNA, 2502 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagatgatagtgaaaaaaaaccccagcgacgcaatcgtagccgcaggcgtcgcttcaggggtcaggcagaagatagacagccaggtaacttgagtggacctgtggacaccatcaggtcacaagcatgaaaaaaatgtcatatgtctgctttctaaatatattatacttacatgtacacatgtgtgcatatacattcaaaatttgcattgcataaattgtttattcaactaataagactactactattaagaaaatgcattcttccttcacagtgtgttagtaacttgtctaattgaactaatgttgtgtcctaattgtttacatggaaatactgttgagaagaccattttgttcacttggcagtttcttcacacttgagatggggcctgccatccgagggactgtgttgtagattgtgatcaaggttgattggcaaaactgggcagcttttgcatggtgcctgcttactatatctgaattcagcacctcatttttgtgggagttgtaatacccacaattaaaaaaaaagtataaaagagaaaaatatttgaaggtgtctttaacctaatgcgaggaatgcatgttgtttttgtttgtttattgtagtgtgatgccttttcccttacacctactaactattcaaattaataatacttacttagttttagaatgtttattttatgtagtcattaatttttagtaacttcaaagaaacttgtttgctgtgtctattattttgaacataattccatttcctgtgtacagagaatcacatgtatattcacaatgaagcaattgtgtgcaccagaaataaacccctttcaaacta

SEQ ID NO: 426326 - DNA, 2706 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagatgatagtgaaaaaaaaccccagcgacgcaatcgtagccgcaggcgtcgcttcaggggtcaggcagaagatagacagccaggtaacttgagtggacctgtggacaccatcaggtcacaagcatgaaaaaaatgtcatatgtctgctttctaaatatattatacttacatgtacacatgtgtgcatatacattcaaaatttgcattgcataaattgtttattcaactaataagactactactattaagaaaatgcattcttccttcacagtgtgttagtaacttgtctaattgaactaatgttgtgtcctaattgtttacatggaaatactgttgagaagaccattttgttcacttggcagtttcttcacacttgagatggggcctgccatccgagggactgtgttgtagattgtgatcaaggttgattggcaaaactgggcagcttttgcatggtgcctgcttactatatctgaattcagcacctcatttttgtgggagttgtaatacccacaattaaaaaaaaagtataaaagagaaaaatatttgaaggtgtctttaacctaatgcgaggaatgcatgttgtttttgtttgtttattgtagtgtgatgccttttcccttacacctactaactattcaaattaataatacttacttagttttagaatgtttattttatgtagtcattaatttttagtaacttcaaagaaacttgtttgctgtgtctattattttgaacataattccatttcctgtgtacagagaatcacatgtatattcacaatgaagcaattgtgtgcaccagaaataaacccctttcaaactaatcaatttttgcattctttccaaaaccagttctttcatgtgttttccccaaataaagaatgtaaattctggcatctttactattttaaatttagtggttgtagagacatttgggaaaactggttaagagaattagttcccatccctaaaagttcatgttttaaagatagttggaaatttttagagcaattaaatattgtcaaaa

SEQ ID NO: 426327 - DNA, 1640 bp, Homo sapiens
  misc_feature (47)..(47): n is a, c, g, or t
gtctagaggatcccgccagtagagatgatgaacagctgcgacagatnggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426328 - DNA, 1688 bp, Homo sapiens
gtaaagacccctggtgattggtcattggcaggagaagatgatcgagatcagccgacatcagcgtgacagcaggagacgcccaggaggaagaggcagaagtgtttcagggggtcgaggtcgtggtggaccacgttggtggcaaatcctccatcagttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426329 - DNA, 1520 bp, Homo sapiens
  misc_feature (32)..(32): n is a, c, g, or t
ctgttctagaggatccctcataggttcgcagngagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426330 - DNA, 1175 bp, Homo sapiens
  misc_feature (3)..(3): n is a, c, g, or t
ggnccactctagagtatcccccgttgacacttcagttaatgaaaatgggcttcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426331 - DNA, 1393 bp, Homo sapiens
  misc_feature (357)..(357): n is a, c, g, or t
  misc_feature (385)..(385): n is a, c, g, or t
  misc_feature (391)..(391): n is a, c, g, or t
ctcaaggatccttatttttttaatccccccccccccccccccccgggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaaaaacaaacaacaaaaaaaaaaaaaagtgggtggggcgcgccccgggaccccgcgaaaaagcctttaagaaaacacattcgcgggtggggcgcgcgggggccccagggaggagtaagtttgganggcgctccgatgcaaaacatgtttgggnacaggncctcaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426332 - DNA, 1230 bp, Homo sapiens
tcaggctttcatcttgcctcttttaaaataattataaatgacactggtaaaggtacatatatcaagagtaggcattaattttcaagggctaaaatgtcattaacttcggtataaaccaaactgtactagagaggaagactgtgtccctgaatgatggcagtttaagtctgagttttactgtgagttaaaaccctctgaatttccagatgataattccatttttaatccatttggaatgctgaaagctacaaaaatgtatttcctgtcagtaaacatttgttgttttatttttgtgtttaattaaaagtttatttttcccctttaaatctttgaaggaaagaaggtttttttgtttttttgtttgtttttgtcagaatagttcatggtaaactttgcaattacagatgatagtgaaaaaaaaccccagcgacgcaatcgtagccgcaggcgtcgcttcaggggtcaggcagaagatagacagccaggtaacttgagtggacctgtggacaccatcaggtcacaagcatgaaaaaaatgtcatatgtctgctttctaaatatattatacttacatgtacacatgtgtgcatatacattcaaaatttgcattgcataaattgtttattcaactaataagactactactattaagaaaatgcattcttccttcacagtgtgttagtaacttgtctaattgaactaatgttgtgtcctaattgtttacatggaaatactgttgagaagaccattttgttcacttggcagtttcttcacacttgagatggggcctgccatccgagggactgtgttgtagattgtgatcaaggttgattggcaaaactgggcagcttttgcatggtgcctgcttactatatctgaattcagcacctcatttttgtgggagttgtaatacccacaattaaaaaaaaagtataaaagagaaaaatatttgaaggtgtctttaacctaatgcgaggaatgcatgttgtttttgtttgtttattgtagtgtgatgccttttcccttacacctactaactattcaaattaataatacttacttagttttagaatgtttattttatgtagtcattaatttttagtaacttcaaagaaacttgtttgctgtgtctattattttgaacataattccatttcctgtgtacagagaatcacatgtatattcacaatgaagcaattgtgtgcaccagaaataaacccctttcaaacta

SEQ ID NO: 426333 - DNA, 1176 bp, Homo sapiens
tcaggctttcatcttgcctcttttaaaataattataaatgacactggtaaaggtacatatatcaagagtaggcattaattttcaagggctaaaatgtcattaacttcggtataaaccaaactgtactagagaggaagactgtgtccctgaatgatggcagtttaagtctgagttttactgtgagttaaaaccctctgaatttccagatgataattccatttttaatccatttggaatgctgaaagctacaaaaatgtatttcctgtcagtaaacatttgttgttttatttttgtgtttaattaaaagtttatttttcccctttaaatctttgaaggaaagaaggtttttttgtttttttgtttgtttttgtcagaatagttcatggtaaactttgcaattacagatgatagtgaaaaaaaaccccagcgacgcaatcgtagccgcaggcgtcgcttcaggggtcaggcagaagatagacagccaggtaacttgagtggacctgtggacaccatcaggtcacaagcatgaaaaaaatgtcatatgtctgctttctaaatatattatacttacatgtacacatgtgtgcatatacattcaaaatttgcattgcataaattgtttattcaactaataagactactactattaagtgtgtcctaattgtttacatggaaatactgttgagaagaccattttgttcacttggcagtttcttcacacttgagatggggcctgccatccgagggactgtgttgtagattgtgatcaaggttgattggcaaaactgggcagcttttgcatggtgcctgcttactatatctgaattcagcacctcatttttgtgggagttgtaatacccacaattaaaaaaaaagtataaaagagaaaaatatttgaaggtgtctttaacctaatgcgaggaatgcatgttgtttttgtttgtttattgtagtgtgatgccttttcccttacacctactaactattcaaattaataatacttacttagttttagaatgtttattttatgtagtcattaatttttagtaacttcaaagaaacttgtttgctgtgtctattattttgaacataattccatttcctgtgtacagagaatcacatgtatattcacaatgaagcaattgtgtgcaccagaaataaacccctttcaaacta

SEQ ID NO: 426334 - DNA, 599 bp, Homo sapiens
ctcaaggatccttatttttttaatccccccccccccccccccccgggcctttgcggttccaacatggcggagctgacggtggaggttcgcggctctaacggggctttctacaagtcaattcacaatgaatcaaatgtccccattttggaactctgaagtatttataattgatctctatacatatctacaatctactgcttgtttctacttagactttgactccattactcattttgcctcacaaagtgagttggtactttgacaaaggttggaaaggacactagccacctgtgtgtgcactgaaatcatgtacgcttgaacatttggaattttatgtccagccataatccacttgcatatgcactttgtggaaactgtggtcttcagaactctggaagaatgagaatggcggagtggaaaagagtcctggatttgaagtaaacagatgagaattctaggtctgtacttcaccttaccattatctaacaatggacccctgaacaaatctctctgtctaacatgaggggcttgaagtagttctgtgatccccagtatatttttatcctattaaactgctgacttgaaaaccattggcttat

SEQ ID NO: 426335 - DNA, 315 bp, Homo sapiens
ttgctgaatttttttaactttctactttttacaccaattgttgcaaaatagttggagctattaataggcttaggatagtatactttgctttttaaaaagcatttatacttgctcataaatagcattaaaatgtcagttggccatttaatcattttgtaatgaatcatctgaaatctttacacaagtttaggctgttagatgcataggtaattaataatacatgtgataattagcaaaaaaacctaacaaaattctaatcaaaggcaactttggaagacaatgggggatagaagggatgacaagcaatttttaaat

SEQ ID NO: 426336 - DNA, 451 bp, Homo sapiens
taaatgctttacagtatttgatatgtaaatgtgatttctcaaaataaggtgagtaaagtaggtgattatttgtttaatattaactgtttatgtcattttcatggtgagctttccagtgttttaaaattaggtacagttttcattagtttagatgttttctgtggtttgggcactgctaggtactagagatacaaagttgaaagacccatagagtggaatactttgttatttgttttgaattttaaagatgttttaatactttgatccattgtggtatataaaactgaaatttttaattagctaattagtgtttatgtagctgttttcctcctcagctatagatttcatttataaagaagttgaaaaagttgtctccctttggcaggcaaaagatgtgattgaagagcatggtccttcagaaaaggcaataaacggcccaactagtgcttct

SEQ ID NO: 426337 - DNA, 409 bp, Homo sapiens
cttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttc

SEQ ID NO: 426338 - DNA, 2800 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426339 - DNA, 3132 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttccaaaaaaaaaaaaacaaaaagatattcgataactacagtacatcgcagctacaaaacgggggggctgtcataatgataattaccgccaggatggaaactatatcaatgcctacccccctatcttgtgttcgaaaaaagtggtccatatgttagacgtaactatcaactacaatctatcagtgttattacaatcatgcgtgatagaaaaagttgttatgactacttgttggagacccatccgtgtggtgggaataatggagaccacacagctatataacccgggaataaatacgacttatgagcaacctgtttgttgaaaaattattacataata

SEQ ID NO: 426340 - DNA, 2887 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggtatgggtttcagaccttcttccaccagagggcctgaaaaagagaaaggatatgccactgatgaaagtaccgtctcttctgtacaaggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426341 - DNA, 2178 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctaaaaaaaaaagaacaaacacaaaagacacaaacacacgacagaccccagcaccccaacacaccacaaaacacacaccg

SEQ ID NO: 426342 - DNA, 2747 bp, Homo sapiens
ttagctagtacgaggctgggtgttcgaatcggccgaggggaggtcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426343 - DNA, 2987 bp, Homo sapiens
ctcaaggatccttatttttttaatccccccccccccccccccccgggcctttgcggttccaacatggcggagctgacggtggaggttcgcggctctaacggggctttctacaagtcaattcacaatgaatcaaatgtccccattttggaactctgaagtatttataattgatctctatacatatctacaatctactgcttgtttctacttagactttgactccattactcattttgcctcacaaagtgagttggtactttgacaaaggttggaaaggacactagccacctgtgtgtgcactgaaatcatgtacgcttgaacatttggaattttatgtccagccataatccacttgcatatgcactttgtggaaactgtggtcttcagaactctggaagaatgagaatggcggagtggaaaagagtcctggatttgaagtaaacagatgagaattctaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426344 - DNA, 1760 bp, Homo sapiens
ctatcagctcggtaccgacgacaggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426345 - DNA, 2124 bp, Homo sapiens
  misc_feature (53)..(53): n is a, c, g, or t
gcccctcccccctcctcccctctggttggaaagtttctagaatctcttcccgnggggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctggtagtcttttctatactctgtcagcatccattatttgtaaacagtttaattttacaaaagttaattcatctcccagggccacccatttttggaagtttctcttgctactcattgtcttagagaaagtagtggaccatatagcagtatcaggaaaagccctcgtagagtgtttctcagtgaaggtttacttagaatatactggtcagaactttagttggcagcttttctttatatgatgagggtcagatgtttctctcttcaggttttggaggcttatttaattagaattttttttgttttccctagaattttggggttatgtttttttgtttgccagacagacccagagatttctaatgcacagagagatgtcagtacttttctatacttaatattgaaaacgaagtgaagagcattcttagctacactatgtagtactttgggaacagggaaaaattgtggaattaactaagttttttaattgttggaggaactgtgctgtaaagaggagtgtttggatgactaaagatttgagggtgtaggaaacgttttacttaattacttctgtcttctaaaatttttttatgctttacattaagttgtaggagtttccagaatatccttggttaccataacgggctagggagtt

SEQ ID NO: 426346 - DNA, 1473 bp, Homo sapiens
  misc_feature (6)..(6): n is a, c, g, or t
gtgcgnccttgcattagtgcagttcgagcatagtattatcgggatcattgaatgaaacgccaggatgcaagacgtgcagaactgtctcgatcgtgtgtacgagggttctgtgctgtggaaaaccctgtggggtcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426347 - DNA, 1609 bp, Homo sapiens
tcaggctttcatcttgcctcttttaaaataattataaatgacactggtaaaggtacatatatcaagagtaggcattaattttcaagggctaaaatgtcattaacttcggtataaaccaaactgtactagagaggaagactgtgtccctgaatgatggcagtttaagtctgagttttactgtgagttaaaaccctctgaatttccagatgataattccatttttaatccatttggaatgctgaaagctacaaaaatgtatttcctgtcagtaaacatttgttgttttatttttgtgtttaattaaaagtttatttttcccctttaaatctttgaaggaaagaaggtttttttgtttttttgtttgtttttgtcagaatagttcatggtaaactttgcaattacagatgatagtgaaaaaaaaccccagcgacgcaatcgtagccgcaggcgtcgcttcaggggtcaggcagaagatagacagccagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426348 - DNA, 1332 bp, Homo sapiens
gaggaaagcaaagtgtcaagggggccagtcgtgtggccagtgggtgcaaatccccatcaggtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcaattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttcca

SEQ ID NO: 426349 - DNA, 1042 bp, Homo sapiens
ccgcacgggcaagacgcggaggagcggccccagccagaagacagggcacccgcggccttgctgcgcatgctcgcgctgtgaccccggcttgaggtaacagcgcgagctgaggctggggcccttggcgcggaggctgagggacccgccgcggcgctgtcgccggagagggagggcaccgctgtcgtcggccagaagccaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagccaggcacagaagtcatcccggcagcccccaggaagcccagaaagttctccaaactggtcctgctcacagcctccaaagacagcaccaaggtggcgggggccaagcgcaagggtgtgcactgtgtcatgtccctgggggtgcccggccccgccacccttgccaaggccctcctccagacccaccccgaggcccagcgggccattgaggcagcccctcaggagcctgagcagaaacggagcaggcaggacccaggcacagacagaacagaagacagtggattagcagcggggcctcctgaggctgctggggagaactttgccccctgctctgtggcgcccggcaagtccctgtaaccttgacaacaggcgcatcctcccaggccaccaacccagccataggctcttctctgtccgcagggcttctggggccaaatgggtgaatctttgctttcaacattgtgtgatttcttttctttttttttttttttttagatcaagtataagttacttttgtaagcagaaaaatactttcaaacaagaataaaagaagctgttcgctagaccccaaaaaaaaaaggttttaaaca

SEQ ID NO: 426350 - DNA, 1174 bp, Homo sapiens
  misc_feature (36)..(36): n is a, c, g, or t
  misc_feature (90)..(90): n is a, c, g, or t
  misc_feature (92)..(92): n is a, c, g, or t
  misc_feature (108)..(109): n is a, c, g, or t
  misc_feature (124)..(124): n is a, c, g, or t
  misc_feature (167)..(167): n is a, c, g, or t
ctaatccacttgtcttctgttcttgtcttgtccctnggtcctgccttgctccgtttcttgcttcaggcttccttgaggggcttgccttcnanattcgcttgggcctcnnggtgggtcttggagnagggccttggcaagggttgcggggccgggcacccccagggacnttgacacagggcacccgcggccttgctgcgcatgctcgcgctgtgaccccggcttgaggtaacagcgcgagctgaggctggggcccttggcgcggaggctgagggacccgccgcggcgctgtcgccggagagggagggcaccgctgtcgtcggccagaagccaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagccaggcacagaagtcatcccggcagcccccaggaagcccagaaagttctccaaactggtcctgctcacagcctccaaagacagcaccaaggtggcgggggccaagcgcaagggtgtgcactgtgtcatgtccctgggggtgcccggccccgccacccttgccaaggccctcctccagacccaccccgaggcccagcgggccattgaggcagcccctcaggagcctgagcagaaacggagcaggcaggacccaggcacagacagaacagaagacagtggattagcagcggggcctcctgaggctgctggggagaactttgccccctgctctgtggcgcccggcaagtccctgtaaccttgacaacaggcgcatcctcccaggccaccaacccagccataggctcttctctgtccgcagggcttctggggccaaatgggtgaatctttgctttcaacattgtgtgatttcttttctttttttttttttttttagatcaagtataagttacttttgtaagcagaaaaatactttcaaacaagaataaaagaagctgttcgctagaccccaaaaaaaaaaggttttaaaca

SEQ ID NO: 426351 - DNA, 1104 bp, Homo sapiens
  misc_feature (36)..(36): n is a, c, g, or t
  misc_feature (90)..(90): n is a, c, g, or t
  misc_feature (92)..(92): n is a, c, g, or t
  misc_feature (108)..(109): n is a, c, g, or t
  misc_feature (124)..(124): n is a, c, g, or t
  misc_feature (167)..(167): n is a, c, g, or t
ctaatccacttgtcttctgttcttgtcttgtccctnggtcctgccttgctccgtttcttgcttcaggcttccttgaggggcttgccttcnanattcgcttgggcctcnnggtgggtcttggagnagggccttggcaagggttgcggggccgggcacccccagggacnttgacacagggcacccgcggccttgctgcgcatgctcgcgctgtgaccccggcttgaggtaacagcgcgagctgaggctggggcccttggcgcggaggctgagggacccgccgcggcgctgtcgccggagagggagggcaccgctgtcgtcggccagaagccaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagccaggcacagaagtcatcccggcagcccccaggaagcccagaaagttctccaaactggtcctgctcacagcctccaaagacagcaccttgccaaggccctcctccagacccaccccgaggcccagcgggccattgaggcagcccctcaggagcctgagcagaaacggagcaggcaggacccaggcacagacagaacagaagacagtggattagcagcggggcctcctgaggctgctggggagaactttgccccctgctctgtggcgcccggcaagtccctgtaaccttgacaacaggcgcatcctcccaggccaccaacccagccataggctcttctctgtccgcagggcttctggggccaaatgggtgaatctttgctttcaacattgtgtgatttcttttctttttttttttttttttagatcaagtataagttacttttgtaagcagaaaaatactttcaaacaagaataaaagaagctgttcgctagaccccaaaaaaaaaaggttttaaaca

SEQ ID NO: 426352 - DNA, 908 bp, Homo sapiens
ccgcacgggcaagacgcggaggagcggccccagccagaagacagggcacccgcggccttgctgcgcatgctcgcgctgtgaccccggcttgaggtaacagcgcgagctgaggctggggcccttggcgcggaggctgagggacccgccgcggcgctgtcgccggagagggagggcaccgctgtcgtcggccagaagccaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagccaggcacagaagtcatcccggcagcccccaggaagcccagaaagttctccaaactggtcctgctcacagcctccaaagacagcaccaaggtggcgggggccaagcgcaagggtgtgcactgtgtcatgtccctgggggtgcccggccccgccacccttgccaaggccctcctccagacccaccccgaggcccagcgggccattgaggcagcccctgtaaccttgacaacaggcgcatcctcccaggccaccaacccagccataggctcttctctgtccgcagggcttctggggccaaatgggtgaatctttgctttcaacattgtgtgatttcttttctttttttttttttttttagatcaagtataagttacttttgtaagcagaaaaatactttcaaacaagaataaaagaagctgttcgctagaccccaaaaaaaaaaggttttaaaca

SEQ ID NO: 426353 - DNA, 880 bp, Homo sapiens
  misc_feature (36)..(36): n is a, c, g, or t
  misc_feature (90)..(90): n is a, c, g, or t
  misc_feature (92)..(92): n is a, c, g, or t
  misc_feature (108)..(109): n is a, c, g, or t
  misc_feature (124)..(124): n is a, c, g, or t
  misc_feature (167)..(167): n is a, c, g, or t
ctaatccacttgtcttctgttcttgtcttgtccctnggtcctgccttgctccgtttcttgcttcaggcttccttgaggggcttgccttcnanattcgcttgggcctcnnggtgggtcttggagnagggccttggcaagggttgcggggccgggcacccccagggacnttgacacagggcacccgcggccttgctgcgcatgctcgcgctgtgaccccggcttgaggtaacagcgcgagctgaggctggggcccttggcgcggaggctgagggacccgccgcggcgctgtcgccggagagggagggcaccgctgtcgtcggccagaagccaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagcctgaggctgctggggagaactttgccccctgctctgtggcgcccggcaagtccctgtaaccttgacaacaggcgcatcctcccaggccaccaacccagccataggctcttctctgtccgcagggcttctggggccaaatgggtgaatctttgctttcaacattgtgtgatttcttttctttttttttttttttttagatcaagtataagttacttttgtaagcagaaaaatactttcaaacaagaataaaagaagctgttcgctagaccccaaaaaaaaaaggttttaaaca

SEQ ID NO: 426354 - DNA, 1080 bp, Homo sapiens
  misc_feature (36)..(36): n is a, c, g, or t
  misc_feature (90)..(90): n is a, c, g, or t
  misc_feature (92)..(92): n is a, c, g, or t
  misc_feature (108)..(109): n is a, c, g, or t
  misc_feature (124)..(124): n is a, c, g, or t
  misc_feature (167)..(167): n is a, c, g, or t
ctaatccacttgtcttctgttcttgtcttgtccctnggtcctgccttgctccgtttcttgcttcaggcttccttgaggggcttgccttcnanattcgcttgggcctcnnggtgggtcttggagnagggccttggcaagggttgcggggccgggcacccccagggacnttgacacagggcacccgcggccttgctgcgcatgctcgcgctgtgaccccggcttgaggccagaagccaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagccaggcacagaagtcatcccggcagcccccaggaagcccagaaagttctccaaactggtcctgctcacagcctccaaagacagcaccaaggtggcgggggccaagcgcaagggtgtgcactgtgtcatgtccctgggggtgcccggccccgccacccttgccaaggccctcctccagacccaccccgaggcccagcgggccattgaggcagcccctcaggagcctgagcagaaacggagcaggcaggacccaggcacagacagaacagaagacagtggattagcagcggggcctcctgaggctgctggggagaactttgccccctgctctgtggcgcccggcaagtccctgtaaccttgacaacaggcgcatcctcccaggccaccaacccagccataggctcttctctgtccgcagggcttctggggccaaatgggtgaatctttgctttcaacattgtgtgatttcttttctttttttttttttttttagatcaagtataagttacttttgtaagcagaaaaatactttcaaacaagaataaaagaagctgttcgctagaccccaaaaaaaaaaggttttaaaca

SEQ ID NO: 426355 - DNA, 6584 bp, Homo sapiens
gcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtcccaaagcctggaagggtagtactacaaatgatccaccaaagcaaagccctgggtccacttcccctaaaccccctcatacattaagccgcaagcagtggcggaaccggcaaaagaataagagaagatgtaagaacaagtttcagccacctcaggtgccagaccaggccccagctgaggcccccacagagaagacagaggtgtctcctgttcccaggacagacagccatgaggctcgggcaggggctttgcgagcccgcatggcacagcggctggatggggcccgatttcgctacctcaatgaacagttgtactcagggcccagcagtgctgcacagcgtctcttccaggaagaccctgaggcttttcttctctaccaccgcggcttccagagccaagtgaagaagtggccactgcagccagtggaccgcatcgccagggatcttcgccagcggcctgcatccctagtggtggctgacttcggctgtggggattgccgcttggcttcaagtatccggaaccctgtgcattgctttgacttggcttctctggaccctagggtcactgtgtgtgacatggcccaggttcctctggaggatgagtctgtggatgtggctgtgttttgcctttcactgatgggaaccaacatcagggacttcctagaggaggcaaatagagtactgaagccagggggtctcctgaaagtggctgaggtcagcagccgctttgaggatgttcgaacctttctgcgggctgtgaccaagctaggcttcaagattgtctccaaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaacaataaagagtttattgtgagaacatggggatatctgtctcatgacacttcaggtgttatgaaaactagatggtttggaattcaaggcatctttaggttttgctcttctttccaactaagaagccacatggccttcctgtcctgccatctccactctgctgtcatctgatctgtctacagatcagcttcctctgctcacccatagcttctgctccttcagcttcagtttgcccaggccttcaaggttgcagacaggcagctgttgctgtttgactctgaggcaactggttgtccaccaacatcttggctcaagacatcagtctgagccaccaacttgagactgtttggttgtccccataccgagcatttctagtggtttatctttcccctctcccctcatctccatttttggaaccatatagcatcaagccactcccaacacctattgtcctgtgggactttgggatgtatatagctgagagcacagattttggaatcaggtagacctggatttaattcttggcctgctacccagaggcacttaaagtcatttaatctctgtatatcacattcctcatttggaaaatggtagaatttttgtcttgcagggtggttgtgtgggttaactggagaaatctgtagccagggctgggaacataggaggtgctcagtaaactagctatgactattatgtgttgtaagccttattgttttttgaagatcttccctaggctggttggaggctgaggggtaaagaatggatttgttgactaaggaagcctctgggagaggctagacctttcaacaggcctgcttcataggctatttaatgacttttaatagattctgagcttctgtccttggaggggtagtgagggagctgggtctctgttcataaacaacttgttgatgccatgtgggcttgggggcattgggctgttcattggcggaagagtctgtccactatctctgccttgcagtggactcagatcagcatgtcctgggaaagctataggcaaggtgctgagggaaggtgagtttgaatgatagattctaggcctcccccaaaaggtatctgccatgtgcccaggtataaagatatggcctcttgtacttgtttccaggaatacctgacagtacccattgggagatcataggttctatgccctgagccagttggatgcctctaataaggggatggaggttttgaaacaggctgtagtccagagggcatgtttggaggctgggctgtgaatcattaggcaggcactacacagtgcctctacacgtactgttctttctgctggatattcatcggactggcagtttgctcatctttccgaacagcctagttgtttcctattctactcccaaagcaaaatcagttcttcatctgtactctcaaagtactatgtgaagagtgctacttcagcttctaaatattgcattgtgattcctttgtgcatttggctgctgttttctcaagccatgtttatctttgtattcccggagcttgtcatttgagatatagccagtgtacttattcacctagggagagataaggaatgacagggtccagttgagtgggatagatgagaacaggggtgttatagaaacccaggtactagggcacaagatgagggcactgttgactagtcatgatggaagaagtaggcagacaggagaacttcattaggtagaattggtgggatgttgaggttggtaagagaggaatctgaagtaagttccaggttgctcaactgtgggtaggctggtgatgccattcaaagtgttggattttaggaagtgggacatgcgtgaaatctgtgctgggggtctgggaatcagcagcctagaggtggtaattaaagtcagaatagatgagatattcagggtaagataatgagaagagaaaatggctcagaatagaactgaggagcatgtcatggatgggtaaaggaaaatgaagcagtgaaggtgatggaagaggagaaggttcacccagagatgtaggagtaaaaccaggagagttaatttttttttttttttttttttaagacagagtcttgctctgtggcccaggctggaatgcggtggcgtgatctcaggtcactgaaacctctgcctgctggttcaagcacttctcctgcctcagactcccgagtagctgggaatacaggcacatgccaccacgcccagctaatttttgtatttttagtagtgacggggtttcaccatgttggccaggctggtctcgaactcctgacctcgagtgatcggcctgcctcggcctcccaaagtgctgggattacaggcatgagccactgtgcccagccagtgttttttttttttttttttttatgggaggatgggcaggttgttagctgtcgagtgctattgagatgagagagaactcagaatgcagtggggtaaggattgctgagtaatgtggagggcctgtttgaggtaaatggcagtggtaagaggttgctccattatgaaagccctcttccagagttcctgatagggccccagaagttcatttctgattgctttgattttttttcaggggagcaggaagccagtttatcatttgagagtgagaataggggagaggaaatatcttccaggcccacagtgcatagaaatacccagtcagggcaaaatgatttatctgtttacctctcctcatcacttgggcccagagcaatcagcagtgattaggtagagaggagccgaggagagggaagagcataccaatcactcctccctttcccagtgcaggctcctagacttagctggggcagagctgggagaggaaaaagggatttaaaactgcaacaggtgcagattattgttacacaggattagacattctaattaattgagattatgtttgttccttaaactgatcacaggactatctattaagaacatcacaacctcgctgcagcttttctccatagcagggagagtacctcccagtgaataaaatttggagggtggtaagagacaagaataaaattgggtttggttatccgtgcctcatgcttgttcagcatccctttgagagttctccaaataaatagttactgcttctgcagttattggtgtgctccagcttctgttcccataatatagtccagtcctaagggaacacagttctaaaagaaacaacatgatcttggcagagacaccgctcagctccaaacccaaccatttatgtaactgcacaaaactctctacagcttttcacagagaccagtaattagaacctttcatcccctggtcatcctccttcccaggtgaattctctgaccagccatctggttttaggatacccaactcctgcagtaactgccttactggtggtctaattgcttctactcgtgtccctaaagcaattaattttccacacagccatgtgatctttttaaaatgtaaatcagcttatgtcacttctctgcttaaaatccttcaatggattctcactgcctcgagaacaaaagacaaacttttcaggccccgtgtgatcttgcccaggcctccgtcaccatcaccatctgcatcttaacccactcctcccctttcacaaaactccagccacacagacttgctttttattcctcaagctttccaaactgtttctactgagagtctttgcacatgctccatcttccttgaatactctttccccagtgagctcattttcatcttcctgaattcataccactattacctttgcttctgtggaagaaactggccagatgctcacccaaatgtcctctttctggacacaggtaaactgcatttcccagctccatgcatctaggcctatgtgagtagttctcaacagtggaaaatgagtggaagtgatgtttcaatactagaccaaggcagttaaagggtggctgagccatttccattattctcttcctccttcctcttcaaggtaaccttgaagcacatgttttgacggtgatggagtcatagcatagaagaagtctgaatacctgagttactatttagggcataatagctacttgaccaaaaacatccatattggactttgaacaagaaaataaacttgattacattctgctagtgagttttgagggtgttttagcagttatcattatatacactggatatatcttctatggtatcctgtccaccttactcttgaccacagtaccctctttgtttccttcagggtgtttcagatatttaattatcttgccagatgccagtcaacactttctttttgtcccatgagtttaaaatcaggggaaaacatgtactcccaataggaagttgagatactcttttttttttaaatccgtcattgtgactgtgaccagaaaaacaaatcccactaaagaatgtcctaaacagatgtttttttttgtcatataacctggagttaggtgatttggcattggttctggagctgaaggatgttagggatgaggtctctgtagttttcttgtctcatggtcacgaaatgaagtgttattgattaagcagggatgccctacttagtattagacttcttggaagtctccttaattgccacagcccctatctttttggcttcgtttcaagggtccttctacattgttaatactctggtataaatacgttccattattccctataacatgactgaaaccaatctaaagtattaacattttaaatatgtttttgggccaagtgcagtggctcttatctgtgatcccagctactaggaaggctgaggtgggaggattgcttgagcccaggaatttcaggctgtagtgagctatgattgtgccactgtactccggcctggataactgagatcctgtctcaataaataaataaaacaatt

SEQ ID NO: 426356 - DNA, 1736 bp, Homo sapiens
gcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtcccaaagcctggaagggtagtactacaaatgatccaccaaagcaaagccctgggtccacttcccctaaaccccctcatacattaagccgcaagcagtggcggaaccggcaaaagaataagagaagatgtaagaacaagtttcagccacctcaggtgccagaccaggccccagctgaggcccccacagagaagacagaggtgtctcctgttcccaggacagacagccatgaggctcgggcaggggctttgcgagcccgcatggcacagcggctggatggggcccgatttcgctacctcaatgaacagttgtactcagggcccagcagtgctgcacagcgtctcttccaggaagaccctgaggcttttcttctctaccaccgcggcttccagagccaagtgaagaagtggccactgcagccagtggaccgcatcgccagggatcttcgccagcggcctgcatccctagtggtggctgacttcggctgtggggattgccgcttggcttcaagtatccggaaccctgtgcattgctttgacttggcttctctggaccctagggtcactgtgtgtgacatggcccaggttcctctggaggatgagtctgtggatgtggctgtgttttgcctttcactgatgggaaccaacatcagggacttcctagaggaggcaaatagagtactgaagccagggggtctcctgaaagtggctgaggtcagcagccgctttgaggatgttcgaacctttctgcgggctgtgaccaagctaggcttcaagattgtctccaaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaacaataaagagtttattgtgaga

SEQ ID NO: 426357 - DNA, 1159 bp, Homo sapiens
gcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaagttgggcaagacctgaagctcacagcatgcacatgaggaaagcagcgtcgtacccatagctgggcttcgcatgattccagtcgagcagccagcagggctaccagctcactgtcactaaggaagaagaggcgggggaagtgagcacacaccccatagagcacgctctccagactcatgatgatgccctccagctccaccgatcctgcttgcagcagttgttgcagctgctggccttggaagtaagggctcctctcggcactgggcactacaagtgacagaaccatggggtcagctacagagatgcgcatcagggttcgatactggtcatccatgaccttgaaacgagagttctgtggtgagggagaggataaaagtgagggccaatatgaagtggcagctcccctttcccacgctgagccctgctattcaggaacccttcttgccctctctgcctcaacccccttccctaccaggtcagcattaggaaactggatcttcatctcatgcagaactttattcagaaaaatccacttctgctggaaagtcagccacacctccagcagggcacctgtgtaagcagccagaggaatgctggtgggaaacactagggttctaccttctgcaggggagtccaccctgctcctgacctctcaggtaccccaccagcccaagcaaaatactctgcccagcaggactcagggaacttgcttgagggagaaaaaactttcactgtgaataaaaacctgatctcttcatcccaagaaacagcctgaaggaggtcctcactgtgttcttcatatcttctcccacccaacctccacctctcacccccatccctctgggacatcctgcctcaggtctcacccatcagcctggctagaggcctgcacttacccaggccatgcatgatggccaccca

SEQ ID NO: 426358 - DNA, 582 bp, Homo sapiens
gcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaagttgggcaagacctgaagctcacagcatgcacatgaggaaagcagcgtcgtacccatagctgggcttcgcatgattccagtcgagcagccagcagggctaccagctcactgtcactaaggaagaagaggcgggggaagtgagcacacaccccatagagcacgctctccagactcatgatgatgccctccagctccaccgatcctgcttgcagcagttgttgcagctgctggccttggaatatgtgataccctccaccatgggatgagactctcgccagatgctcttggacttcccagcctccagaaccatgaaccaaataaacttttattctttataaatta

SEQ ID NO: 426359 - DNA, 1829 bp, Homo sapiens
gcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtcccaaagcctggaagggtagtactacaaatgatccaccaaagcaaagccctgggtccacttcccctaaaccccctcatacattaagccgcaagcagtggcggaaccggcaaaagaataagagaagatgtaagaacaagtttcagccacctcaggtgccagaccaggccccagctgaggcccccacagagaagacagaggtgtctcctgttcccaggacagacagccatgaggctcgggcaggggctttgcgagcccgcatggcacagcggctggatggggcccgatttcgctacctcaatgaacagttgtactcagggcccagcagtgctgcacagcgtctcttccaggaagaccctgaggcttttcttctctaccaccgcggcttccagagccaagtgaagaagtggccactgcagccagtggaccgcatcgccagggatcttcgccagcggtgaatgggggtcagggactgtgagaagccatgtggtgggtcagtcataggctcagatcagaccaatatgtgacccttgccttccactctcaggcctgcatccctagtggtggctgacttcggctgtggggattgccgcttggcttcaagtatccggaaccctgtgcattgctttgacttggcttctctggaccctagggtcactgtgtgtgacatggcccaggttcctctggaggatgagtctgtggatgtggctgtgttttgcctttcactgatgggaaccaacatcagggacttcctagaggaggcaaatagagtactgaagccagggggtctcctgaaagtggctgaggtcagcagccgctttgaggatgttcgaacctttctgcgggctgtgaccaagctaggcttcaagattgtctccaaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaacaataaagagtttattgtgaga

SEQ ID NO: 426360 - DNA, 6900 bp, Homo sapiens
gcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtcccaaagcctggaagggtagtactacaaatgatccaccaaagcaaagccctgggtccacttcccctaaaccccctcatacattaagccgcaagcagtggcggaaccggcaaaagaataagagaagatgtaagaacaagtttcagccacctcaggtgccagaccaggccccagctgaggcccccacagagaagacagaggtgtctcctgttcccaggacagacagccatgaggctcgggcaggggctttgcgagcccgcatggcacagcggctggatggggcccgatttcgctacctcaatgaacagttgtactcagggcccagcagtgctgcacagcgtctcttccaggaagaccctgaggcttttcttctctaccaccgcggcttccagagccaagtgaagaagtggccactgcagccagtggaccgcatcgccagggatcttcgccagcggtgaatgggggtcagggactgtgagaagccatgtggtgggtcagtcataggctcagatcagaccaatatgtgacccttgccttccactctcaggcctgcatccctagtggtggctgacttcggctgtggggattgccgcttggcttcaagtatccggaaccctgtgcattgctttgacttggcttctctggaccctagggtcactgtgtgtgacatggcccaggttcctctggaggatgagtctgtggatgtggctgtgttttgcctttcactgatgggaaccaacatcagggacttcctagaggaggcaaatagagtactgaagccagggggtctcctgaaagtggctgaggtcagcagccgctttgaggatgttcgaacctttctgcgggctgtgaccaagctaggcttcaagattgtctccaaggtgagggccccaagacatctgtacctgtttttgtctcatgtggccctattcagggtactggtgttcaggaaggaggctttaggcacaggaacagacattttgctccccaacggaagtgggagccctgggaagctttgtgagcagaggcagtacatagagggaggtgttttaaggagttgggatgaggatttggttctcactgggtcttttctgcccctaggacgacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaacaataaagagtttattgtgagaacatggggatatctgtctcatgacacttcaggtgttatgaaaactagatggtttggaattcaaggcatctttaggttttgctcttctttccaactaagaagccacatggccttcctgtcctgccatctccactctgctgtcatctgatctgtctacagatcagcttcctctgctcacccatagcttctgctccttcagcttcagtttgcccaggccttcaaggttgcagacaggcagctgttgctgtttgactctgaggcaactggttgtccaccaacatcttggctcaagacatcagtctgagccaccaacttgagactgtttggttgtccccataccgagcatttctagtggtttatctttcccctctcccctcatctccatttttggaaccatatagcatcaagccactcccaacacctattgtcctgtgggactttgggatgtatatagctgagagcacagattttggaatcaggtagacctggatttaattcttggcctgctacccagaggcacttaaagtcatttaatctctgtatatcacattcctcatttggaaaatggtagaatttttgtcttgcagggtggttgtgtgggttaactggagaaatctgtagccagggctgggaacataggaggtgctcagtaaactagctatgactattatgtgttgtaagccttattgttttttgaagatcttccctaggctggttggaggctgaggggtaaagaatggatttgttgactaaggaagcctctgggagaggctagacctttcaacaggcctgcttcataggctatttaatgacttttaatagattctgagcttctgtccttggaggggtagtgagggagctgggtctctgttcataaacaacttgttgatgccatgtgggcttgggggcattgggctgttcattggcggaagagtctgtccactatctctgccttgcagtggactcagatcagcatgtcctgggaaagctataggcaaggtgctgagggaaggtgagtttgaatgatagattctaggcctcccccaaaaggtatctgccatgtgcccaggtataaagatatggcctcttgtacttgtttccaggaatacctgacagtacccattgggagatcataggttctatgccctgagccagttggatgcctctaataaggggatggaggttttgaaacaggctgtagtccagagggcatgtttggaggctgggctgtgaatcattaggcaggcactacacagtgcctctacacgtactgttctttctgctggatattcatcggactggcagtttgctcatctttccgaacagcctagttgtttcctattctactcccaaagcaaaatcagttcttcatctgtactctcaaagtactatgtgaagagtgctacttcagcttctaaatattgcattgtgattcctttgtgcatttggctgctgttttctcaagccatgtttatctttgtattcccggagcttgtcatttgagatatagccagtgtacttattcacctagggagagataaggaatgacagggtccagttgagtgggatagatgagaacaggggtgttatagaaacccaggtactagggcacaagatgagggcactgttgactagtcatgatggaagaagtaggcagacaggagaacttcattaggtagaattggtgggatgttgaggttggtaagagaggaatctgaagtaagttccaggttgctcaactgtgggtaggctggtgatgccattcaaagtgttggattttaggaagtgggacatgcgtgaaatctgtgctgggggtctgggaatcagcagcctagaggtggtaattaaagtcagaatagatgagatattcagggtaagataatgagaagagaaaatggctcagaatagaactgaggagcatgtcatggatgggtaaaggaaaatgaagcagtgaaggtgatggaagaggagaaggttcacccagagatgtaggagtaaaaccaggagagttaatttttttttttttttttttttaagacagagtcttgctctgtggcccaggctggaatgcggtggcgtgatctcaggtcactgaaacctctgcctgctggttcaagcacttctcctgcctcagactcccgagtagctgggaatacaggcacatgccaccacgcccagctaatttttgtatttttagtagtgacggggtttcaccatgttggccaggctggtctcgaactcctgacctcgagtgatcggcctgcctcggcctcccaaagtgctgggattacaggcatgagccactgtgcccagccagtgttttttttttttttttttttatgggaggatgggcaggttgttagctgtcgagtgctattgagatgagagagaactcagaatgcagtggggtaaggattgctgagtaatgtggagggcctgtttgaggtaaatggcagtggtaagaggttgctccattatgaaagccctcttccagagttcctgatagggccccagaagttcatttctgattgctttgattttttttcaggggagcaggaagccagtttatcatttgagagtgagaataggggagaggaaatatcttccaggcccacagtgcatagaaatacccagtcagggcaaaatgatttatctgtttacctctcctcatcacttgggcccagagcaatcagcagtgattaggtagagaggagccgaggagagggaagagcataccaatcactcctccctttcccagtgcaggctcctagacttagctggggcagagctgggagaggaaaaagggatttaaaactgcaacaggtgcagattattgttacacaggattagacattctaattaattgagattatgtttgttccttaaactgatcacaggactatctattaagaacatcacaacctcgctgcagcttttctccatagcagggagagtacctcccagtgaataaaatttggagggtggtaagagacaagaataaaattgggtttggttatccgtgcctcatgcttgttcagcatccctttgagagttctccaaataaatagttactgcttctgcagttattggtgtgctccagcttctgttcccataatatagtccagtcctaagggaacacagttctaaaagaaacaacatgatcttggcagagacaccgctcagctccaaacccaaccatttatgtaactgcacaaaactctctacagcttttcacagagaccagtaattagaacctttcatcccctggtcatcctccttcccaggtgaattctctgaccagccatctggttttaggatacccaactcctgcagtaactgccttactggtggtctaattgcttctactcgtgtccctaaagcaattaattttccacacagccatgtgatctttttaaaatgtaaatcagcttatgtcacttctctgcttaaaatccttcaatggattctcactgcctcgagaacaaaagacaaacttttcaggccccgtgtgatcttgcccaggcctccgtcaccatcaccatctgcatcttaacccactcctcccctttcacaaaactccagccacacagacttgctttttattcctcaagctttccaaactgtttctactgagagtctttgcacatgctccatcttccttgaatactctttccccagtgagctcattttcatcttcctgaattcataccactattacctttgcttctgtggaagaaactggccagatgctcacccaaatgtcctctttctggacacaggtaaactgcatttcccagctccatgcatctaggcctatgtgagtagttctcaacagtggaaaatgagtggaagtgatgtttcaatactagaccaaggcagttaaagggtggctgagccatttccattattctcttcctccttcctcttcaaggtaaccttgaagcacatgttttgacggtgatggagtcatagcatagaagaagtctgaatacctgagttactatttagggcataatagctacttgaccaaaaacatccatattggactttgaacaagaaaataaacttgattacattctgctagtgagttttgagggtgttttagcagttatcattatatacactggatatatcttctatggtatcctgtccaccttactcttgaccacagtaccctctttgtttccttcagggtgtttcagatatttaattatcttgccagatgccagtcaacactttctttttgtcccatgagtttaaaatcaggggaaaacatgtactcccaataggaagttgagatactcttttttttttaaatccgtcattgtgactgtgaccagaaaaacaaatcccactaaagaatgtcctaaacagatgtttttttttgtcatataacctggagttaggtgatttggcattggttctggagctgaaggatgttagggatgaggtctctgtagttttcttgtctcatggtcacgaaatgaagtgttattgattaagcagggatgccctacttagtattagacttcttggaagtctccttaattgccacagcccctatctttttggcttcgtttcaagggtccttctacattgttaatactctggtataaatacgttccattattccctataacatgactgaaaccaatctaaagtattaacattttaaatatgtttttgggccaagtgcagtggctcttatctgtgatcccagctactaggaaggctgaggtgggaggattgcttgagcccaggaatttcaggctgtagtgagctatgattgtgccactgtactccggcctggataactgagatcctgtctcaataaataaataaaacaatt

SEQ ID NO: 426361 - DNA, 1307 bp, Homo sapiens
gcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtcccaaagcctggaagggtagtactacaaatgatccaccaaagcaaagccctgggtccacttcccctaaaccccctcatacattaagccgcaagcagtggcggaaccggcaaaagaataagagaagatgtaagaacaagtttcagccacctcaggtgccagaccaggccccagctgaggcccccacagagaagacagaggtgtctcctgttcccaggacagacagccatgaggctcgggcaggggctttgcgagcccgcatggcacagcggctggatggggcccgatttcgctacctcaatgaacagttgtactcagggcccagcagtgctgcacagcgtctcttccaggaagaccctgaggcttttcttctctaccaccgcggcttccagagccaagtgaagaagtggccactgcagccagtggaccgcatcgccagggatcttcgccagcggcctgcatccctagtggtggctgacttcggctgtggggattgccgcttggcttcaagtatccggaaccctgtgcattgctttgacttggcttctctggaccctagggtcactgtgtgtgacatggcccaggtaaacccctatgttatctggcttgtgctctagggccaacctccgtatgctaatctctaacccttccttcccctttcccatcctggtatctcactgctggctgatgaatcttctgcac

SEQ ID NO: 426362 - DNA, 1785 bp, Homo sapiens
gcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaaggcctcatccattctctttaggcccactgtcatcccctgttttcctccagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtcccaaagcctggaagggtagtactacaaatgatccaccaaagcaaagccctgggtccacttcccctaaaccccctcatacattaagccgcaagcagtggcggaaccggcaaaagaataagagaagatgtaagaacaagtttcagccacctcaggtgccagaccaggccccagctgaggcccccacagagaagacagaggtgtctcctgttcccaggacagacagccatgaggctcgggcaggggctttgcgagcccgcatggcacagcggctggatggggcccgatttcgctacctcaatgaacagttgtactcagggcccagcagtgctgcacagcgtctcttccaggaagaccctgaggcttttcttctctaccaccgcggcttccagagccaagtgaagaagtggccactgcagccagtggaccgcatcgccagggatcttcgccagcggcctgcatccctagtggtggctgacttcggctgtggggattgccgcttggcttcaagtatccggaaccctgtgcattgctttgacttggcttctctggaccctagggtcactgtgtgtgacatggcccaggttcctctggaggatgagtctgtggatgtggctgtgttttgcctttcactgatgggaaccaacatcagggacttcctagaggaggcaaatagagtactgaagccagggggtctcctgaaagtggctgaggtcagcagccgctttgaggatgttcgaacctttctgcgggctgtgaccaagctaggcttcaagattgtctccaaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaacaataaagagtttattgtgaga

SEQ ID NO: 426363 - DNA, 5815 bp, Homo sapiens
gcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaaggcctcatccattctctttaggcccactgtcatcccctgttttcctccagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaacaataaagagtttattgtgagaacatggggatatctgtctcatgacacttcaggtgttatgaaaactagatggtttggaattcaaggcatctttaggttttgctcttctttccaactaagaagccacatggccttcctgtcctgccatctccactctgctgtcatctgatctgtctacagatcagcttcctctgctcacccatagcttctgctccttcagcttcagtttgcccaggccttcaaggttgcagacaggcagctgttgctgtttgactctgaggcaactggttgtccaccaacatcttggctcaagacatcagtctgagccaccaacttgagactgtttggttgtccccataccgagcatttctagtggtttatctttcccctctcccctcatctccatttttggaaccatatagcatcaagccactcccaacacctattgtcctgtgggactttgggatgtatatagctgagagcacagattttggaatcaggtagacctggatttaattcttggcctgctacccagaggcacttaaagtcatttaatctctgtatatcacattcctcatttggaaaatggtagaatttttgtcttgcagggtggttgtgtgggttaactggagaaatctgtagccagggctgggaacataggaggtgctcagtaaactagctatgactattatgtgttgtaagccttattgttttttgaagatcttccctaggctggttggaggctgaggggtaaagaatggatttgttgactaaggaagcctctgggagaggctagacctttcaacaggcctgcttcataggctatttaatgacttttaatagattctgagcttctgtccttggaggggtagtgagggagctgggtctctgttcataaacaacttgttgatgccatgtgggcttgggggcattgggctgttcattggcggaagagtctgtccactatctctgccttgcagtggactcagatcagcatgtcctgggaaagctataggcaaggtgctgagggaaggtgagtttgaatgatagattctaggcctcccccaaaaggtatctgccatgtgcccaggtataaagatatggcctcttgtacttgtttccaggaatacctgacagtacccattgggagatcataggttctatgccctgagccagttggatgcctctaataaggggatggaggttttgaaacaggctgtagtccagagggcatgtttggaggctgggctgtgaatcattaggcaggcactacacagtgcctctacacgtactgttctttctgctggatattcatcggactggcagtttgctcatctttccgaacagcctagttgtttcctattctactcccaaagcaaaatcagttcttcatctgtactctcaaagtactatgtgaagagtgctacttcagcttctaaatattgcattgtgattcctttgtgcatttggctgctgttttctcaagccatgtttatctttgtattcccggagcttgtcatttgagatatagccagtgtacttattcacctagggagagataaggaatgacagggtccagttgagtgggatagatgagaacaggggtgttatagaaacccaggtactagggcacaagatgagggcactgttgactagtcatgatggaagaagtaggcagacaggagaacttcattaggtagaattggtgggatgttgaggttggtaagagaggaatctgaagtaagttccaggttgctcaactgtgggtaggctggtgatgccattcaaagtgttggattttaggaagtgggacatgcgtgaaatctgtgctgggggtctgggaatcagcagcctagaggtggtaattaaagtcagaatagatgagatattcagggtaagataatgagaagagaaaatggctcagaatagaactgaggagcatgtcatggatgggtaaaggaaaatgaagcagtgaaggtgatggaagaggagaaggttcacccagagatgtaggagtaaaaccaggagagttaatttttttttttttttttttttaagacagagtcttgctctgtggcccaggctggaatgcggtggcgtgatctcaggtcactgaaacctctgcctgctggttcaagcacttctcctgcctcagactcccgagtagctgggaatacaggcacatgccaccacgcccagctaatttttgtatttttagtagtgacggggtttcaccatgttggccaggctggtctcgaactcctgacctcgagtgatcggcctgcctcggcctcccaaagtgctgggattacaggcatgagccactgtgcccagccagtgttttttttttttttttttttatgggaggatgggcaggttgttagctgtcgagtgctattgagatgagagagaactcagaatgcagtggggtaaggattgctgagtaatgtggagggcctgtttgaggtaaatggcagtggtaagaggttgctccattatgaaagccctcttccagagttcctgatagggccccagaagttcatttctgattgctttgattttttttcaggggagcaggaagccagtttatcatttgagagtgagaataggggagaggaaatatcttccaggcccacagtgcatagaaatacccagtcagggcaaaatgatttatctgtttacctctcctcatcacttgggcccagagcaatcagcagtgattaggtagagaggagccgaggagagggaagagcataccaatcactcctccctttcccagtgcaggctcctagacttagctggggcagagctgggagaggaaaaagggatttaaaactgcaacaggtgcagattattgttacacaggattagacattctaattaattgagattatgtttgttccttaaactgatcacaggactatctattaagaacatcacaacctcgctgcagcttttctccatagcagggagagtacctcccagtgaataaaatttggagggtggtaagagacaagaataaaattgggtttggttatccgtgcctcatgcttgttcagcatccctttgagagttctccaaataaatagttactgcttctgcagttattggtgtgctccagcttctgttcccataatatagtccagtcctaagggaacacagttctaaaagaaacaacatgatcttggcagagacaccgctcagctccaaacccaaccatttatgtaactgcacaaaactctctacagcttttcacagagaccagtaattagaacctttcatcccctggtcatcctccttcccaggtgaattctctgaccagccatctggttttaggatacccaactcctgcagtaactgccttactggtggtctaattgcttctactcgtgtccctaaagcaattaattttccacacagccatgtgatctttttaaaatgtaaatcagcttatgtcacttctctgcttaaaatccttcaatggattctcactgcctcgagaacaaaagacaaacttttcaggccccgtgtgatcttgcccaggcctccgtcaccatcaccatctgcatcttaacccactcctcccctttcacaaaactccagccacacagacttgctttttattcctcaagctttccaaactgtttctactgagagtctttgcacatgctccatcttccttgaatactctttccccagtgagctcattttcatcttcctgaattcataccactattacctttgcttctgtggaagaaactggccagatgctcacccaaatgtcctctttctggacacaggtaaactgcatttcccagctccatgcatctaggcctatgtgagtagttctcaacagtggaaaatgagtggaagtgatgtttcaatactagaccaaggcagttaaagggtggctgagccatttccattattctcttcctccttcctcttcaaggtaaccttgaagcacatgttttgacggtgatggagtcatagcatagaagaagtctgaatacctgagttactatttagggcataatagctacttgaccaaaaacatccatattggactttgaacaagaaaataaacttgattacattctgctagtgagttttgagggtgttttagcagttatcattatatacactggatatatcttctatggtatcctgtccaccttactcttgaccacagtaccctctttgtttccttcagggtgtttcagatatttaattatcttgccagatgccagtcaacactttctttttgtcccatgagtttaaaatcaggggaaaacatgtactcccaataggaagttgagatactcttttttttttaaatccgtcattgtgactgtgaccagaaaaacaaatcccactaaagaatgtcctaaacagatgtttttttttgtcatataacctggagttaggtgatttggcattggttctggagctgaaggatgttagggatgaggtctctgtagttttcttgtctcatggtcacgaaatgaagtgttattgattaagcagggatgccctacttagtattagacttcttggaagtctccttaattgccacagcccctatctttttggcttcgtttcaagggtccttctacattgttaatactctggtataaatacgttccattattccctataacatgactgaaaccaatctaaagtattaacattttaaatatgtttttgggccaagtgcagtggctcttatctgtgatcccagctactaggaaggctgaggtgggaggattgcttgagcccaggaatttcaggctgtagtgagctatgattgtgccactgtactccggcctggataactgagatcctgtctcaataaataaataaaacaatt

SEQ ID NO: 426364 - DNA, 5636 bp, Homo sapiens
gcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaaggttcctctggaggatgagtctgtggatgtggctgtgttttgcctttcactgatgggaaccaacatcagggacttcctagaggaggcaaatagagtactgaagccagggggtctcctgaaagtggctgaggtcagcagccgctttgaggatgttcgaacctttctgcgggctgtgaccaagctaggcttcaagattgtctccaaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaacaataaagagtttattgtgagaacatggggatatctgtctcatgacacttcaggtgttatgaaaactagatggtttggaattcaaggcatctttaggttttgctcttctttccaactaagaagccacatggccttcctgtcctgccatctccactctgctgtcatctgatctgtctacagatcagcttcctctgctcacccatagcttctgctccttcagcttcagtttgcccaggccttcaaggttgcagacaggcagctgttgctgtttgactctgaggcaactggttgtccaccaacatcttggctcaagacatcagtctgagccaccaacttgagactgtttggttgtccccataccgagcatttctagtggtttatctttcccctctcccctcatctccatttttggaaccatatagcatcaagccactcccaacacctattgtcctgtgggactttgggatgtatatagctgagagcacagattttggaatcaggtagacctggatttaattcttggcctgctacccagaggcacttaaagtcatttaatctctgtatatcacattcctcatttggaaaatggtagaatttttgtcttgcagggtggttgtgtgggttaactggagaaatctgtagccagggctgggaacataggaggtgctcagtaaactagctatgactattatgtgttgtaagccttattgttttttgaagatcttccctaggctggttggaggctgaggggtaaagaatggatttgttgactaaggaagcctctgggagaggctagacctttcaacaggcctgcttcataggctatttaatgacttttaatagattctgagcttctgtccttggaggggtagtgagggagctgggtctctgttcataaacaacttgttgatgccatgtgggcttgggggcattgggctgttcattggcggaagagtctgtccactatctctgccttgcagtggactcagatcagcatgtcctgggaaagctataggcaaggtgctgagggaaggtgagtttgaatgatagattctaggcctcccccaaaaggtatctgccatgtgcccaggtataaagatatggcctcttgtacttgtttccaggaatacctgacagtacccattgggagatcataggttctatgccctgagccagttggatgcctctaataaggggatggaggttttgaaacaggctgtagtccagagggcatgtttggaggctgggctgtgaatcattaggcaggcactacacagtgcctctacacgtactgttctttctgctggatattcatcggactggcagtttgctcatctttccgaacagcctagttgtttcctattctactcccaaagcaaaatcagttcttcatctgtactctcaaagtactatgtgaagagtgctacttcagcttctaaatattgcattgtgattcctttgtgcatttggctgctgttttctcaagccatgtttatctttgtattcccggagcttgtcatttgagatatagccagtgtacttattcacctagggagagataaggaatgacagggtccagttgagtgggatagatgagaacaggggtgttatagaaacccaggtactagggcacaagatgagggcactgttgactagtcatgatggaagaagtaggcagacaggagaacttcattaggtagaattggtgggatgttgaggttggtaagagaggaatctgaagtaagttccaggttgctcaactgtgggtaggctggtgatgccattcaaagtgttggattttaggaagtgggacatgcgtgaaatctgtgctgggggtctgggaatcagcagcctagaggtggtaattaaagtcagaatagatgagatattcagggtaagataatgagaagagaaaatggctcagaatagaactgaggagcatgtcatggatgggtaaaggaaaatgaagcagtgaaggtgatggaagaggagaaggttcacccagagatgtaggagtaaaaccaggagagttaatttttttttttttttttttttaagacagagtcttgctctgtggcccaggctggaatgcggtggcgtgatctcaggtcactgaaacctctgcctgctggttcaagcacttctcctgcctcagactcccgagtagctgggaatacaggcacatgccaccacgcccagctaatttttgtatttttagtagtgacggggtttcaccatgttggccaggctggtctcgaactcctgacctcgagtgatcggcctgcctcggcctcccaaagtgctgggattacaggcatgagccactgtgcccagccagtgttttttttttttttttttttatgggaggatgggcaggttgttagctgtcgagtgctattgagatgagagagaactcagaatgcagtggggtaaggattgctgagtaatgtggagggcctgtttgaggtaaatggcagtggtaagaggttgctccattatgaaagccctcttccagagttcctgatagggccccagaagttcatttctgattgctttgattttttttcaggggagcaggaagccagtttatcatttgagagtgagaataggggagaggaaatatcttccaggcccacagtgcatagaaatacccagtcagggcaaaatgatttatctgtttacctctcctcatcacttgggcccagagcaatcagcagtgattaggtagagaggagccgaggagagggaagagcataccaatcactcctccctttcccagtgcaggctcctagacttagctggggcagagctgggagaggaaaaagggatttaaaactgcaacaggtgcagattattgttacacaggattagacattctaattaattgagattatgtttgttccttaaactgatcacaggactatctattaagaacatcacaacctcgctgcagcttttctccatagcagggagagtacctcccagtgaataaaatttggagggtggtaagagacaagaataaaattgggtttggttatccgtgcctcatgcttgttcagcatccctttgagagttctccaaataaatagttactgcttctgcagttattggtgtgctccagcttctgttcccataatatagtccagtcctaagggaacacagttctaaaagaaacaacatgatcttggcagagacaccgctcagctccaaacccaaccatttatgtaactgcacaaaactctctacagcttttcacagagaccagtaattagaacctttcatcccctggtcatcctccttcccaggtgaattctctgaccagccatctggttttaggatacccaactcctgcagtaactgccttactggtggtctaattgcttctactcgtgtccctaaagcaattaattttccacacagccatgtgatctttttaaaatgtaaatcagcttatgtcacttctctgcttaaaatccttcaatggattctcactgcctcgagaacaaaagacaaacttttcaggccccgtgtgatcttgcccaggcctccgtcaccatcaccatctgcatcttaacccactcctcccctttcacaaaactccagccacacagacttgctttttattcctcaagctttccaaactgtttctactgagagtctttgcacatgctccatcttccttgaatactctttccccagtgagctcattttcatcttcctgaattcataccactattacctttgcttctgtggaagaaactggccagatgctcacccaaatgtcctctttctggacacaggtaaactgcatttcccagctccatgcatctaggcctatgtgagtagttctcaacagtggaaaatgagtggaagtgatgtttcaatactagaccaaggcagttaaagggtggctgagccatttccattattctcttcctccttcctcttcaaggtaaccttgaagcacatgttttgacggtgatggagtcatagcatagaagaagtctgaatacctgagttactatttagggcataatagctacttgaccaaaaacatccatattggactttgaacaagaaaataaacttgattacattctgctagtgagttttgagggtgttttagcagttatcattatatacactggatatatcttctatggtatcctgtccaccttactcttgaccacagtaccctctttgtttccttcagggtgtttcagatatttaattatcttgccagatgccagtcaacactttctttttgtcccatgagtttaaaatcaggggaaaacatgtactcccaataggaagttgagatactcttttttttttaaatccgtcattgtgactgtgaccagaaaaacaaatcccactaaagaatgtcctaaacagatgtttttttttgtcatataacctggagttaggtgatttggcattggttctggagctgaaggatgttagggatgaggtctctgtagttttcttgtctcatggtcacgaaatgaagtgttattgattaagcagggatgccctacttagtattagacttcttggaagtctccttaattgccacagcccctatctttttggcttcgtttcaagggtccttctacattgttaatactctggtataaatacgttccattattccctataacatgactgaaaccaatctaaagtattaacattttaaatatgtttttgggccaagtgcagtggctcttatctgtgatcccagctactaggaaggctgaggtgggaggattgcttgagcccaggaatttcaggctgtagtgagctatgattgtgccactgtactccggcctggataactgagatcctgtctcaataaataaataaaacaatt

SEQ ID NO: 426365 - DNA, 526 bp, Homo sapiens
ctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaaggtgagtgactcgcgggagcaatgggagctgtttcaggccgcgaagcggacattggtggatcccagcgctgtgtgtattgcggggagggacacctgtggcaccgttaagggcgagtcctgatctgaagatccgagaacttccaaaagaaactgacgttgggtcagagagagttgttgagtagaagttggtgaagcgaagagggttcttcagacaggaaaaagtacgtacaagggccctgggacaagagagcatgttctgtcagagtcacaaacacaagtggtccttgtggttgaaata

SEQ ID NO: 426366 - DNA, 351 bp, Homo sapiens
cctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtaccattggatgtgtatatgtgtgtgtgttggtgtgtgtgtgtcggggggtcagctggtt

SEQ ID NO: 426367 - DNA, 3394 bp, Homo sapiens
gacgggtggccccggtcccccggcagggccttctccccccttcggcaccgcagcagcagcgagatcaccctcagcgagtgtgacgcggaggacgcgggggagccgcggggggcccggcacacgggggcgctgcccctcttccgcgagtacgggagcacctcgtccatcgacgtgcagggcatgcccgagcagagcttcttcgacatcctgaacgagttccgcagcgagcagcccgacgcccgagggtgccaggccctcaccgagctcctccgggcagatcctggcccacacctcatggggggcggcggcggagccaagggggactcccacaacgggcagcccgccaaggacagcctcctgccactgcagcccacgaaggagaaggagaaggcccggaagaaacctgcgcggggcctcggcggcggggacacggtggactcgtccatctttcggaagctaaggagcagcaaacccgagggggaggctgggcgttccccgggggaggccgacgagggccggagccccccggaagccagcaggccgtgggtgtgtcagaagagcttcgcccacttcgacgtgcagagcatgctgttcgacctcaacgaggcggccgccaacagggtgtcggtgtcgcagcggcggaacaccaccacgggtgcttcggccgcttccgccgcctcggccatggcctccctcacggcctcgcgggcccacagcctcggaggcctggacccggccttcaccagcacagaggacctaaactgcaaggagaacttggagcaggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaagaacatgccaattacttcggcgtggatgagaagctggggccagtggctgtgagcattaagcgggagaagctggaagaccacaaggagcacggacctcagtaccagtacaggatcatcttccggacccgcgagctcatcaccctgcggggctccatcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaagggctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagaccgactccacgggaacccactccctctacacgatgtaccaggactacgagatcatgttccatgtctccaccctgctcccttacacccccaacaacaggcagcagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctggagggtggtggcccaggactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggggttggccggagacctacgacatgaatacctcggagcccaagacggagcaggaaagcatcactcctgggggccggcccccctaccgcagcaatgctccctggcagtggagcgggcccgcatcccataactctctaccagcctccaagtgggccactccaaccactcccggccatgcccagtccctgagccggcccctgaagcagacccccatagtccccttccgggagtcccagccactgcacagcaagaggcctgtcagcttcccagaaaccccttacacagtatcaccagcaggggccgacagagtccctccctaccgacagccttctgggagcttctccacccccggttcggccacctacgtgagatacaagccatccccagaaaggtacacggctgccccacaccccctgctatctcttgatccccacttcagccacgatgggacgtccagcggcgactcctcttccggcggcctgaccagccaggagagcaccatggaacgccagaagccagagcctttgtggcatgtgcctgcccaggccaggctctcagccatagccggaagcagcgggaacaagcacccgtccaggcaggatgcagcaggcaaagattcccccaacaggcattccaaaggagaacctcaatactcaagtcattccagcaggtcgagcggctgttaatttagtagtagtaggcggcagc

SEQ ID NO: 426368 - DNA, 2831 bp, Homo sapiens
gacgggtggccccggtcccccggcagggccttctccccccttcggcaccgcagcagcagcgagatcaccctcagcgagtgtgacgcggaggacgcgggggagccgcggggggcccggcacacgggggcgctgcccctcttccgcgagtacgggagcacctcgtccatcgacgtgcagggcatgcccgagcagagcttcttcgacatcctgaacgagttccgcagcgagcagcccgacgcccgagggtgccaggccctcaccgagctcctccgggcagatcctggcccacacctcatggggggcggcggcggagccaagggggactcccacaacgggcagcccgccaaggacagcctcctgccactgcagcccacgaaggagaaggagaaggcccggaagaaacctgcgcggggcctcggcggcggggacacggtggactcgtccatctttcggaagctaaggagcagcaaacccgagggggaggctgggcgttccccgggggaggccgacgagggccggagccccccggaagccagcaggccgtgggtgtgtcagaagagcttcgcccacttcgacgtgcagagcatgctgttcgacctcaacgaggcggccgccaacagggtgtcggtgtcgcagcggcggaacaccaccacgggtgcttcggccgcttccgccgcctcggccatggcctccctcacggcctcgcgggcccacagcctcggaggcctggacccggccttcaccagcacagaggacctaaactgcaaggagaacttggagcaggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaagaacatgccaattacttcggcgtggatgagaagctggggccagtggctgtgagcattaagcgggagaagctggaagaccacaaggagcacggacctcagtaccagtacaggatcatcttccggacccgcgagctcatcaccctgcggggctccatcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaagggctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagaccgactccacgggaacccactccctctacacgatgtaccaggactacgagatcatgttccatgtctccaccctgctcccttacacccccaacaacaggcagcagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctggagggtggtggcccaggactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtaagggagagagcccggcgatagggcggcgatttgtatggtttcggcctcaggaaccactgaaatacttccctagcccagtcagttaggctaagacacgcactggcccggagagaatcacagttgtcacttacaaactagacatcttgtgggttctgtagctaggttcttcctctggaaggtttgtgccagagatctgtggatcttcatgctattaccttggaaagacaagagatacttattaaccttggacactgatagaaagtataaatttaagcttaggttaaaaatgtaggccaggcgccatggctcatacctgtaatctatctcagcactttaggaggctgaggtggtggatcgcttgagcccaggaatttccagaccaacctgggtaaccatagtgagactctgcctacaaa

SEQ ID NO: 426369 - DNA, 2769 bp, Homo sapiens
gacgggtggccccggtcccccggcagggccttctccccccttcggcaccgcagcagcagcgagatcaccctcagcgagtgtgacgcggaggacgcgggggagccgcggggggcccggcacacgggggcgctgcccctcttccgcgagtacgggagcacctcgtccatcgacgtgcagggcatgcccgagcagagcttcttcgacatcctgaacgagttccgcagcgagcagcccgacgcccgagggtgccaggccctcaccgagctcctccgggcagatcctggcccacacctcatggggggcggcggcggagccaagggggactcccacaacgggcagcccgccaaggacagcctcctgccactgcagcccacgaaggagaaggagaaggcccggaagaaacctgcgcggggcctcggcggcggggacacggtggactcgtccatctttcggaagctaaggagcagcaaacccgagggggaggctgggcgttccccgggggaggccgacgagggccggagccccccggaagccagcaggccgtgggtgtgtcagaagagcttcgcccacttcgacgtgcagagcatgctgttcgacctcaacgaggcggccgccaacagggtgtcggtgtcgcagcggcggaacaccaccacgggtgcttcggccgcttccgccgcctcggccatggcctccctcacggcctcgcgggcccacagcctcggaggcctggacccggccttcaccagcacagaggacctaaactgcaaggagaacttggagcaggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaagaacatgccaattacttcggcgtggatgagaagctggggccagtggctgtgagcattaagcgggagaagctggaagaccacaaggagcacggacctcagtaccagtacaggatcatcttccggacccgcgagctcatcaccctgcggggctccatcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaagggctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagaccgactccacgggaacccactccctctacacgatgtaccaggactacgagatcatgttccatgtctccaccctgctcccttacacccccaacaacaggcagcagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctggagggtggtggcccaggactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggagatggagtctcgctctgtcgcccaggctgaagtgcagtggcgtgatctcaactcactgcaacctccacctcccgggttcaagc

SEQ ID NO: 426370 - DNA, 5377 bp, Homo sapiens
  misc_feature (4621)..(4621): n is a, c, g, or t
cctgtccccctctgttgccctttcccagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctggagggtggtggcccaggactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggggttggccggagacctacgacatgaatacctcggagcccaagacggagcaggaaagcatcactcctgggggccggcccccctaccgcagcaatgctccctggcagtggagcgggcccgcatcccataactctctaccagcctccaagtgggccactccaaccactcccggccatgcccagtccctgagccggcccctgaagcagacccccatagtccccttccgggagtcccagccactgcacagcaagaggcctgtcagcttcccagaaaccccttacacagtatcaccagcaggggccgacagagtccctccctaccgacagccttctgggagcttctccacccccggttcggccacctacgtgagatacaagccatccccagaaaggtacacggctgccccacaccccctgctatctcttgatccccacttcagccacgatgggacgtccagcggcgactcctcttccggcggcctgaccagccaggagagcaccatggaacgccagaagccagagcctttgtggcatgtgcctgcccaggccaggctctcagccatagccggaagcagcgggaacaagcacccgtccaggcaggatgcagcaggcaaagattcccccaacaggcattccaaaggagaacctcaatactcaagtcattccagcagcaacaccctctccagcaacgcatccagcagccacagcgacgaccgctggttcgaccccctggaccccctggagccagagcaagaccccctctccaagggtggctctagtgacagcggcatcgacaccaccctctacacctccagccctagctgcatgtccctggccaaggctccacggcccgccaagccacacaagccccctggaagtatgggcctttgtggcgggggtcgcgaggccgctgggaggtcccaccacgcagacaggcggcgggaggtctcccctgcccccgcagttgccggccaaagcaagggctaccgaccgaagctgtactcctccggctccagcacccccacgggactggcggggggcagccgagacccaccgaggcagcccagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagcaggtggacacgaacaccaaaaatgtctttgggcaaccgaggttgagggcatccctccgagacctccggtcaccacggaagaactacaaatccaccatcgaggatgacctgaagaaactcatcatcatggacaacctggggccagagcaggagagagacacgggacagtcaccgcagaagggcctgcagcggacgctgtcggacgagagcctgtgcagcgggcgccgggagcccagcttcgccagccccgctggcctagagccagggctgcccagcgacgtgctcttcaccagcacctgcgccttcccgtccagcacgctgcctgcacgccgccagcaccagcacccccacccgcccgtcggccccggtgccacccctgccgccggcagcggctttcccgagaagaaatccaccatctcagcctcggagctctcgctggctgatgggcgggaccgccccctgcggcgcctggaccctgggctgatgcccctgcctgacacagctgctggcctcgagtggtccagcctggtgaacgcagccaaggcatacgaagtgcaaagagccgtctcactcttctctctgaacgacccggccctgagcccggacatcccgcctgcacacagtcctgtccacagccacctgagcctggagaggggacccccgacccccaggaccacccctaccatgagcgaggagccacccctggatctgacaggcaaggtgtaccagctggaggtgatgctgaaacagctgcacactgacctgcagaaggagaagcaggacaaggtggtgctccagtcagaggtggccagcctgcggcagaacaaccagcggctgcaggaggagtcgcaggccgccagcgagcagctgcgcaagtttgcggagatcttctgcagggagaagaaggagctctgaggtgggaggccgccgcccgccttcgctccttcccctcaggccgtggccctgctgcctctctccctccactcagctcccagctgccggtgtgaccaagatgacccatccagggccctccccatggacacggaaactccgatggcctcactagggctgtgagtcagggtcagcgcacacagccctcatgccccagagggcgaagtggtctcaggcctccctccaagctgcccagctgtggtcccggtgagctgggctgtgcttacaccgctcccgggcctgccccgctgtccccatctagcctcttcctgggaccagcccttcgaagctgatggggacggagagaggagccagtctccagacgcctcggctccaggaggtcacacagcaggtttctgcaccacgcacaacaaagttgcggcttgtggggccgaggcccctgcatgaaaagtacagcgtgaaagcaaccctttcttccccacacccagagaggtgaggcccgcgtggacacagaccagggcgcctcggtccctagcacgtgagctccaaaaagcacgaacatgatcccctccctaaccccctcctcccaaaaagcagccaggagcactttcttagagtttaaattattttcttgggggcctgaggatagagagaggcaaggctagcctccagagccgatttatttgagagagaaactctatttggatctccaggacggtttatacgatctttttctatcagctcctcttccgccagaggccactgcacctgggctaggggtccacaggcccctccaccttccagctaaccaggccaggccggggcggtggagccaccacacagccgactctctcctcctcctcccggcacgacctggccctgaccagcagcctcggcctcttctgggttccaggaggggctcccgaagccctcaggacagggctggaggagaacagccttcatctcctcctctggtttttttttcctttgcaagtctcccagcccatctctccgagcagcggccaccagaccccctcaccatgctccccggggagcactgcaccccgcgaaccccactggacgctggttctctaaaggcaataaggggcggccatgccggtgtggtaccacgctgttcctccaggaaaccgtttctttttttccttctttaaaagcaaacagaaaaagatatatatatatatatatatatatttattttttcatgtagagttggcgccagaacaagcctgtatggccacagtctgtggattcatccccccaacctcaagctgaggaccaaggcgtgtcccctgtgggctgggggtcagtgggaggaccagagggatgaagtcagggcaggccggtgccctttttgggaggcancaggcggggaggagttggcggagcaggtctggctgtgagccagcaccaggcaacccggcccttgtccagggacctctgctgccttctctctggggtcaggaacctcagaggagggggctctggggactgcataggacgcaggcactcggaggtgccggtgtggatgggtgggggtgagagaagagggttcttatcgcgtctcctgtgatcagcctctggccccctggaggaggaaacctcagcgctgcccctgcccccaccctcacccccaacaccaagagtgaggtgggcgtgccccaggcagcgtcctcagccctggccagctactgtgatgccatcttctcccccatccccttctctggggggcccacccgtcccccacccccaccccttagaccctcatcgggtccctttttttttttttttttcagttgtctcctcccatcttcagatcattcgaatcattttggggacttaatcatgtacatggacaagtgtaaattatgatttttggttttgttttctgttattttttaaggatttctgcaaaaacagatctatttaatttgaggttgatgttctatccaatggccgaagatagcagcaggttttttttttcatatgttgatttgtttcatttggattttttttttattattctttattgtcttttttttttccccatccctgtcttgagattttctggcatgtttctggaggtttcaaaggaaataaatgtttcatagaaatggcttg

SEQ ID NO: 426371 - DNA, 3700 bp, Homo sapiens
  misc_feature (2944)..(2944): n is a, c, g, or t
tagcacctcgctagatgaatgtgcgtcagaacagccgcagttctcacccatgccaggaatgtacgccggcccggcactctcagagcctcctcggcccctggagccagagcaagaccccctctccaagggtggctctagtgacagcggcatcgacaccaccctctacacctccagccctagctgcatgtccctggccaaggctccacggcccgccaagccacacaagccccctggaagtatgggcctttgtggcgggggtcgcgaggccgctgggaggtcccaccacgcagacaggcggcgggaggtctcccctgcccccgcagttgccggccaaagcaagggctaccgaccgaagctgtactcctccggctccagcacccccacgggactggcggggggcagccgagacccaccgaggcagcccagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagcaggtggacacgaacaccaaaaatgtctttgggcaaccgaggttgagggcatccctccgagacctccggtcaccacggaagaactacaaatccaccatcgaggatgacctgaagaaactcatcatcatggacaacctggggccagagcaggagagagacacgggacagtcaccgcagaagggcctgcagcggacgctgtcggacgagagcctgtgcagcgggcgccgggagcccagcttcgccagccccgctggcctagagccagggctgcccagcgacgtgctcttcaccagcacctgcgccttcccgtccagcacgctgcctgcacgccgccagcaccagcacccccacccgcccgtcggccccggtgccacccctgccgccggcagcggctttcccgagaagaaatccaccatctcagcctcggagctctcgctggctgatgggcgggaccgccccctgcggcgcctggaccctgggctgatgcccctgcctgacacagctgctggcctcgagtggtccagcctggtgaacgcagccaaggcatacgaagtgcaaagagccgtctcactcttctctctgaacgacccggccctgagcccggacatcccgcctgcacacagtcctgtccacagccacctgagcctggagaggggacccccgacccccaggaccacccctaccatgagcgaggagccacccctggatctgacaggcaaggtgtaccagctggaggtgatgctgaaacagctgcacactgacctgcagaaggagaagcaggacaaggtggtgctccagtcagaggtggccagcctgcggcagaacaaccagcggctgcaggaggagtcgcaggccgccagcgagcagctgcgcaagtttgcggagatcttctgcagggagaagaaggagctctgaggtgggaggccgccgcccgccttcgctccttcccctcaggccgtggccctgctgcctctctccctccactcagctcccagctgccggtgtgaccaagatgacccatccagggccctccccatggacacggaaactccgatggcctcactagggctgtgagtcagggtcagcgcacacagccctcatgccccagagggcgaagtggtctcaggcctccctccaagctgcccagctgtggtcccggtgagctgggctgtgcttacaccgctcccgggcctgccccgctgtccccatctagcctcttcctgggaccagcccttcgaagctgatggggacggagagaggagccagtctccagacgcctcggctccaggaggtcacacagcaggtttctgcaccacgcacaacaaagttgcggcttgtggggccgaggcccctgcatgaaaagtacagcgtgaaagcaaccctttcttccccacacccagagaggtgaggcccgcgtggacacagaccagggcgcctcggtccctagcacgtgagctccaaaaagcacgaacatgatcccctccctaaccccctcctcccaaaaagcagccaggagcactttcttagagtttaaattattttcttgggggcctgaggatagagagaggcaaggctagcctccagagccgatttatttgagagagaaactctatttggatctccaggacggtttatacgatctttttctatcagctcctcttccgccagaggccactgcacctgggctaggggtccacaggcccctccaccttccagctaaccaggccaggccggggcggtggagccaccacacagccgactctctcctcctcctcccggcacgacctggccctgaccagcagcctcggcctcttctgggttccaggaggggctcccgaagccctcaggacagggctggaggagaacagccttcatctcctcctctggtttttttttcctttgcaagtctcccagcccatctctccgagcagcggccaccagaccccctcaccatgctccccggggagcactgcaccccgcgaaccccactggacgctggttctctaaaggcaataaggggcggccatgccggtgtggtaccacgctgttcctccaggaaaccgtttctttttttccttctttaaaagcaaacagaaaaagatatatatatatatatatatatatttattttttcatgtagagttggcgccagaacaagcctgtatggccacagtctgtggattcatccccccaacctcaagctgaggaccaaggcgtgtcccctgtgggctgggggtcagtgggaggaccagagggatgaagtcagggcaggccggtgccctttttgggaggcancaggcggggaggagttggcggagcaggtctggctgtgagccagcaccaggcaacccggcccttgtccagggacctctgctgccttctctctggggtcaggaacctcagaggagggggctctggggactgcataggacgcaggcactcggaggtgccggtgtggatgggtgggggtgagagaagagggttcttatcgcgtctcctgtgatcagcctctggccccctggaggaggaaacctcagcgctgcccctgcccccaccctcacccccaacaccaagagtgaggtgggcgtgccccaggcagcgtcctcagccctggccagctactgtgatgccatcttctcccccatccccttctctggggggcccacccgtcccccacccccaccccttagaccctcatcgggtccctttttttttttttttttcagttgtctcctcccatcttcagatcattcgaatcattttggggacttaatcatgtacatggacaagtgtaaattatgatttttggttttgttttctgttattttttaaggatttctgcaaaaacagatctatttaatttgaggttgatgttctatccaatggccgaagatagcagcaggttttttttttcatatgttgatttgtttcatttggattttttttttattattctttattgtcttttttttttccccatccctgtcttgagattttctggcatgtttctggaggtttcaaaggaaataaatgtttcatagaaatggcttg

SEQ ID NO: 426372 - DNA, 7026 bp, Homo sapiens
  misc_feature (6270)..(6270): n is a, c, g, or t
gacgggtggccccggtcccccggcagggccttctccccccttcggcaccgcagcagcagcgagatcaccctcagcgagtgtgacgcggaggacgcgggggagccgcggggggcccggcacacgggggcgctgcccctcttccgcgagtacgggagcacctcgtccatcgacgtgcagggcatgcccgagcagagcttcttcgacatcctgaacgagttccgcagcgagcagcccgacgcccgagggtgccaggccctcaccgagctcctccgggcagatcctggcccacacctcatggggggcggcggcggagccaagggggactcccacaacgggcagcccgccaaggacagcctcctgccactgcagcccacgaaggagaaggagaaggcccggaagaaacctgcgcggggcctcggcggcggggacacggtggactcgtccatctttcggaagctaaggagcagcaaacccgagggggaggctgggcgttccccgggggaggccgacgagggccggagccccccggaagccagcaggccgtgggtgtgtcagaagagcttcgcccacttcgacgtgcagagcatgctgttcgacctcaacgaggcggccgccaacagggtgtcggtgtcgcagcggcggaacaccaccacgggtgcttcggccgcttccgccgcctcggccatggcctccctcacggcctcgcgggcccacagcctcggaggcctggacccggccttcaccagcacagaggacctaaactgcaaggagaacttggagcaggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaagaacatgccaattacttcggcgtggatgagaagctggggccagtggctgtgagcattaagcgggagaagctggaagaccacaaggagcacggacctcagtaccagtacaggatcatcttccggacccgcgagctcatcaccctgcggggctccatcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaagggctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagaccgactccacgggaacccactccctctacacgatgtaccaggactacgagatcatgttccatgtctccaccctgctcccttacacccccaacaacaggcagcagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctggagggtggtggcccaggactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggggttggccggagacctacgacatgaatacctcggagcccaagacggagcaggaaagcatcactcctgggggccggcccccctaccgcagcaatgctccctggcagtggagcgggcccgcatcccataactctctaccagcctccaagtgggccactccaaccactcccggccatgcccagtccctgagccggcccctgaagcagacccccatagtccccttccgggagtcccagccactgcacagcaagaggcctgtcagcttcccagaaaccccttacacagtatcaccagcaggggccgacagagtccctccctaccgacagccttctgggagcttctccacccccggttcggccacctacgtgagatacaagccatccccagaaaggtacacggctgccccacaccccctgctatctcttgatccccacttcagccacgatgggacgtccagcggcgactcctcttccggcggcctgaccagccaggagagcaccatggaacgccagaagccagagcctttgtggcatgtgcctgcccaggccaggctctcagccatagccggaagcagcgggaacaagcacccgtccaggcaggatgcagcaggcaaagattcccccaacaggcattccaaaggagaacctcaatactcaagtcattccagcagcaacaccctctccagcaacgcatccagcagccacagcgacgaccgctggttcgaccccctggaccccctggagccagagcaagaccccctctccaagggtggctctagtgacagcggcatcgacaccaccctctacacctccagccctagctgcatgtccctggccaaggctccacggcccgccaagccacacaagccccctggaagtatgggcctttgtggcgggggtcgcgaggccgctgggaggtcccaccacgcagacaggcggcgggaggtctcccctgcccccgcagttgccggccaaagcaagggctaccgaccgaagctgtactcctccggctccagcacccccacgggactggcggggggcagccgagacccaccgaggcagcccagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagcaggtggacacgaacaccaaaaatgtctttgggcaaccgaggttgagggcatccctccgagacctccggtcaccacggaagaactacaaatccaccatcgaggatgacctgaagaaactcatcatcatggacaacctggggccagagcaggagagagacacgggacagtcaccgcagaagggcctgcagcggacgctgtcggacgagagcctgtgcagcgggcgccgggagcccagcttcgccagccccgctggcctagagccagggctgcccagcgacgtgctcttcaccagcacctgcgccttcccgtccagcacgctgcctgcacgccgccagcaccagcacccccacccgcccgtcggccccggtgccacccctgccgccggcagcggctttcccgagaagaaatccaccatctcagcctcggagctctcgctggctgatgggcgggaccgccccctgcggcgcctggaccctgggctgatgcccctgcctgacacagctgctggcctcgagtggtccagcctggtgaacgcagccaaggcatacgaagtgcaaagagccgtctcactcttctctctgaacgacccggccctgagcccggacatcccgcctgcacacagtcctgtccacagccacctgagcctggagaggggacccccgacccccaggaccacccctaccatgagcgaggagccacccctggatctgacaggcaaggtgtaccagctggaggtgatgctgaaacagctgcacactgacctgcagaaggagaagcaggacaaggtggtgctccagtcagaggtggccagcctgcggcagaacaaccagcggctgcaggaggagtcgcaggccgccagcgagcagctgcgcaagtttgcggagatcttctgcagggagaagaaggagctctgaggtgggaggccgccgcccgccttcgctccttcccctcaggccgtggccctgctgcctctctccctccactcagctcccagctgccggtgtgaccaagatgacccatccagggccctccccatggacacggaaactccgatggcctcactagggctgtgagtcagggtcagcgcacacagccctcatgccccagagggcgaagtggtctcaggcctccctccaagctgcccagctgtggtcccggtgagctgggctgtgcttacaccgctcccgggcctgccccgctgtccccatctagcctcttcctgggaccagcccttcgaagctgatggggacggagagaggagccagtctccagacgcctcggctccaggaggtcacacagcaggtttctgcaccacgcacaacaaagttgcggcttgtggggccgaggcccctgcatgaaaagtacagcgtgaaagcaaccctttcttccccacacccagagaggtgaggcccgcgtggacacagaccagggcgcctcggtccctagcacgtgagctccaaaaagcacgaacatgatcccctccctaaccccctcctcccaaaaagcagccaggagcactttcttagagtttaaattattttcttgggggcctgaggatagagagaggcaaggctagcctccagagccgatttatttgagagagaaactctatttggatctccaggacggtttatacgatctttttctatcagctcctcttccgccagaggccactgcacctgggctaggggtccacaggcccctccaccttccagctaaccaggccaggccggggcggtggagccaccacacagccgactctctcctcctcctcccggcacgacctggccctgaccagcagcctcggcctcttctgggttccaggaggggctcccgaagccctcaggacagggctggaggagaacagccttcatctcctcctctggtttttttttcctttgcaagtctcccagcccatctctccgagcagcggccaccagaccccctcaccatgctccccggggagcactgcaccccgcgaaccccactggacgctggttctctaaaggcaataaggggcggccatgccggtgtggtaccacgctgttcctccaggaaaccgtttctttttttccttctttaaaagcaaacagaaaaagatatatatatatatatatatatatttattttttcatgtagagttggcgccagaacaagcctgtatggccacagtctgtggattcatccccccaacctcaagctgaggaccaaggcgtgtcccctgtgggctgggggtcagtgggaggaccagagggatgaagtcagggcaggccggtgccctttttgggaggcancaggcggggaggagttggcggagcaggtctggctgtgagccagcaccaggcaacccggcccttgtccagggacctctgctgccttctctctggggtcaggaacctcagaggagggggctctggggactgcataggacgcaggcactcggaggtgccggtgtggatgggtgggggtgagagaagagggttcttatcgcgtctcctgtgatcagcctctggccccctggaggaggaaacctcagcgctgcccctgcccccaccctcacccccaacaccaagagtgaggtgggcgtgccccaggcagcgtcctcagccctggccagctactgtgatgccatcttctcccccatccccttctctggggggcccacccgtcccccacccccaccccttagaccctcatcgggtccctttttttttttttttttcagttgtctcctcccatcttcagatcattcgaatcattttggggacttaatcatgtacatggacaagtgtaaattatgatttttggttttgttttctgttattttttaaggatttctgcaaaaacagatctatttaatttgaggttgatgttctatccaatggccgaagatagcagcaggttttttttttcatatgttgatttgtttcatttggattttttttttattattctttattgtcttttttttttccccatccctgtcttgagattttctggcatgtttctggaggtttcaaaggaaataaatgtttcatagaaatggcttg

SEQ ID NO: 426373 - DNA, 3417 bp, Homo sapiens
gacgggtggccccggtcccccggcagggccttctccccccttcggcaccgcagcagcagcgagatcaccctcagcgagtgtgacgcggaggacgcgggggagccgcggggggcccggcacacgggggcgctgcccctcttccgcgagtacgggagcacctcgtccatcgacgtgcagggcatgcccgagcagagcttcttcgacatcctgaacgagttccgcagcgagcagcccgacgcccgagggtgccaggccctcaccgagctcctccgggcagatcctggcccacacctcatggggggcggcggcggagccaagggggactcccacaacgggcagcccgccaaggacagcctcctgccactgcagcccacgaaggagaaggagaaggcccggaagaaacctgcgcggggcctcggcggcggggacacggtggactcgtccatctttcggaagctaaggagcagcaaacccgagggggaggctgggcgttccccgggggaggccgacgagggccggagccccccggaagccagcaggccgtgggtgtgtcagaagagcttcgcccacttcgacgtgcagagcatgctgttcgacctcaacgaggcggccgccaacagggtgtcggtgtcgcagcggcggaacaccaccacgggtgcttcggccgcttccgccgcctcggccatggcctccctcacggcctcgcgggcccacagcctcggaggcctggacccggccttcaccagcacagaggacctaaactgcaaggagaacttggagcaggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaagaacatgccaattacttcggcgtggatgagaagctggggccagtggctgtgagcattaagcgggagaagctggaagaccacaaggagcacggacctcagtaccagtacaggatcatcttccggacccgcgagctcatcaccctgcggggctccatcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaagggctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagaccgactccacgggaacccactccctctacacgatgtaccaggactacgagatcatgttccatgtctccaccctgctcccttacacccccaacaacaggcagcagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctggagggtggtggcccaggactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggtaagggcctccacctttcagccaggtggtgggtggcagctcccagatcgctggcatgaggcctccctggcactgtcacttgaggtcccaatagaggggggataggcaggcccttctaggcaggaatagtggcaacagtgacaggacggggagggcacatctacagagcgcttactgtatgccagttattggtttagcccttcatacgtgcatgatcgcatttaatctccacagttgccctgtgaggggagagcctcattcttcccatttcctacatgaagcacaggatgttaatagttgcttgcctgtgggccccccacacttcattcatttgttcaaaatgtgtttattgagcccctactgtgtgcaagctctgttcaaagtgaccacaacaaagtgcctgctcccttgcggtttgtgttctacagggaaagacaggccgtgaagaaataggtgtgtcataccggatcaggtagtactaagtctcagaaggaaattaaagcagggtaatgaaggggctgcagcacgatgggagagctgcttacaaggcgggcagagaaggctccacgaggctccacagggaggcagccatgtggttttctggccagcgggctccagacaggagctggccagggcacagcctccccagtgtacatgggtgatgtgttcctggagtacggggaggcccatgtggctggagcagagcgagcaggagtgagagctgagagca

SEQ ID NO: 426374 - DNA, 1534 bp, Homo sapiens
gacgggtggccccggtcccccggcagggccttctccccccttcggcaccgcagcagcagcgagatcaccctcagcgagtgtgacgcggaggacgcgggggagccgcggggggcccggcacacgggggcgctgcccctcttccgcgagtacgggagcacctcgtccatcgacgtgcagggcatgcccgagcagagcttcttcgacatcctgaacgagttccgcagcgagcagcccgacgcccgagggtgccaggccctcaccgagctcctccgggcagatcctggcccacacctcatggggggcggcggcggagccaagggggactcccacaacgggcagcccgccaaggacagcctcctgccactgcagcccacgaaggagaaggagaaggcccggaagaaacctgcgcggggcctcggcggcggggacacggtggactcgtccatctttcggaagctaaggagcagcaaacccgagggggaggctgggcgttccccgggggaggccgacgagggccggagccccccggaagccagcaggccgtgggtgtgtcagaagagcttcgcccacttcgacgtgcagagcatgctgttcgacctcaacgaggcggccgccaacagggtgtcggtgtcgcagcggcggaacaccaccacgggtgcttcggccgcttccgccgcctcggccatggcctccctcacggcctcgcgggcccacagcctcggaggcctggacccggccttcaccagcacagaggacctaaactgcaaggagaacttggagcaggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaagaacatgccaattacttcggcgtggatgagaagctggggccagtggctgtgagcattaagcgggagaagctggaagaccacaaggagcacggacctcagtaccagtacaggatcatcttccggacccgcgagctcatcaccctgcggggctccatcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaaggggtgagtcaggggctggaggtgggggtgctgctggggcagtaccttgcaaccccactcctggtagctttttctatcttggtcactttcttttttctttgcaagtaacagaaacctacttaagctggtttcagcaaaa

SEQ ID NO: 426375 - DNA, 4731 bp, Homo sapiens
  misc_feature (3975)..(3975): n is a, c, g, or t
ctgggacccactggaggcatcagcccggaagcaggtggctaaattgaagaacacatcttcctacaggcgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggggttggccggagacctacgacatgaatacctcggagcccaagacggagcaggaaagcatcactcctgggggccggcccccctaccgcagcaatgctccctggcagtggagcgggcccgcatcccataactctctaccagcctccaagtgggccactccaaccactcccggccatgcccagtccctgagccggcccctgaagcagacccccatagtccccttccgggagtcccagccactgcacagcaagaggcctgtcagcttcccagaaaccccttacacagtatcaccagcaggggccgacagagtccctccctaccgacagccttctgggagcttctccacccccggttcggccacctacgtgagatacaagccatccccagaaaggtacacggctgccccacaccccctgctatctcttgatccccacttcagccacgatgggacgtccagcggcgactcctcttccggcggcctgaccagccaggagagcaccatggaacgccagaagccagagcctttgtggcatgtgcctgcccaggccaggctctcagccatagccggaagcagcgggaacaagcacccgtccaggcaggatgcagcaggcaaagattcccccaacaggcattccaaaggagaacctcaatactcaagtcattccagcagcaacaccctctccagcaacgcatccagcagccacagcgacgaccgctggttcgaccccctggaccccctggagccagagcaagaccccctctccaagggtggctctagtgacagcggcatcgacaccaccctctacacctccagccctagctgcatgtccctggccaaggctccacggcccgccaagccacacaagccccctggaagtatgggcctttgtggcgggggtcgcgaggccgctgggaggtcccaccacgcagacaggcggcgggaggtctcccctgcccccgcagttgccggccaaagcaagggctaccgaccgaagctgtactcctccggctccagcacccccacgggactggcggggggcagccgagacccaccgaggcagcccagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagcaggtggacacgaacaccaaaaatgtctttgggcaaccgaggttgagggcatccctccgagacctccggtcaccacggaagaactacaaatccaccatcgaggatgacctgaagaaactcatcatcatggacaacctggggccagagcaggagagagacacgggacagtcaccgcagaagggcctgcagcggacgctgtcggacgagagcctgtgcagcgggcgccgggagcccagcttcgccagccccgctggcctagagccagggctgcccagcgacgtgctcttcaccagcacctgcgccttcccgtccagcacgctgcctgcacgccgccagcaccagcacccccacccgcccgtcggccccggtgccacccctgccgccggcagcggctttcccgagaagaaatccaccatctcagcctcggagctctcgctggctgatgggcgggaccgccccctgcggcgcctggaccctgggctgatgcccctgcctgacacagctgctggcctcgagtggtccagcctggtgaacgcagccaaggcatacgaagtgcaaagagccgtctcactcttctctctgaacgacccggccctgagcccggacatcccgcctgcacacagtcctgtccacagccacctgagcctggagaggggacccccgacccccaggaccacccctaccatgagcgaggagccacccctggatctgacaggcaaggtgtaccagctggaggtgatgctgaaacagctgcacactgacctgcagaaggagaagcaggacaaggtggtgctccagtcagaggtggccagcctgcggcagaacaaccagcggctgcaggaggagtcgcaggccgccagcgagcagctgcgcaagtttgcggagatcttctgcagggagaagaaggagctctgaggtgggaggccgccgcccgccttcgctccttcccctcaggccgtggccctgctgcctctctccctccactcagctcccagctgccggtgtgaccaagatgacccatccagggccctccccatggacacggaaactccgatggcctcactagggctgtgagtcagggtcagcgcacacagccctcatgccccagagggcgaagtggtctcaggcctccctccaagctgcccagctgtggtcccggtgagctgggctgtgcttacaccgctcccgggcctgccccgctgtccccatctagcctcttcctgggaccagcccttcgaagctgatggggacggagagaggagccagtctccagacgcctcggctccaggaggtcacacagcaggtttctgcaccacgcacaacaaagttgcggcttgtggggccgaggcccctgcatgaaaagtacagcgtgaaagcaaccctttcttccccacacccagagaggtgaggcccgcgtggacacagaccagggcgcctcggtccctagcacgtgagctccaaaaagcacgaacatgatcccctccctaaccccctcctcccaaaaagcagccaggagcactttcttagagtttaaattattttcttgggggcctgaggatagagagaggcaaggctagcctccagagccgatttatttgagagagaaactctatttggatctccaggacggtttatacgatctttttctatcagctcctcttccgccagaggccactgcacctgggctaggggtccacaggcccctccaccttccagctaaccaggccaggccggggcggtggagccaccacacagccgactctctcctcctcctcccggcacgacctggccctgaccagcagcctcggcctcttctgggttccaggaggggctcccgaagccctcaggacagggctggaggagaacagccttcatctcctcctctggtttttttttcctttgcaagtctcccagcccatctctccgagcagcggccaccagaccccctcaccatgctccccggggagcactgcaccccgcgaaccccactggacgctggttctctaaaggcaataaggggcggccatgccggtgtggtaccacgctgttcctccaggaaaccgtttctttttttccttctttaaaagcaaacagaaaaagatatatatatatatatatatatatttattttttcatgtagagttggcgccagaacaagcctgtatggccacagtctgtggattcatccccccaacctcaagctgaggaccaaggcgtgtcccctgtgggctgggggtcagtgggaggaccagagggatgaagtcagggcaggccggtgccctttttgggaggcancaggcggggaggagttggcggagcaggtctggctgtgagccagcaccaggcaacccggcccttgtccagggacctctgctgccttctctctggggtcaggaacctcagaggagggggctctggggactgcataggacgcaggcactcggaggtgccggtgtggatgggtgggggtgagagaagagggttcttatcgcgtctcctgtgatcagcctctggccccctggaggaggaaacctcagcgctgcccctgcccccaccctcacccccaacaccaagagtgaggtgggcgtgccccaggcagcgtcctcagccctggccagctactgtgatgccatcttctcccccatccccttctctggggggcccacccgtcccccacccccaccccttagaccctcatcgggtccctttttttttttttttttcagttgtctcctcccatcttcagatcattcgaatcattttggggacttaatcatgtacatggacaagtgtaaattatgatttttggttttgttttctgttattttttaaggatttctgcaaaaacagatctatttaatttgaggttgatgttctatccaatggccgaagatagcagcaggttttttttttcatatgttgatttgtttcatttggattttttttttattattctttattgtcttttttttttccccatccctgtcttgagattttctggcatgtttctggaggtttcaaaggaaataaatgtttcatagaaatggcttg

SEQ ID NO: 426376 - DNA, 375 bp, Homo sapiens
cttagtgcctttcttcccaccatctaaataatctctccctccacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctgga

SEQ ID NO: 426377 - DNA, 6804 bp, Homo sapiens
  misc_feature (620)..(620): n is a, c, g, or t
cagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccnaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagcagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaagcctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgat

SEQ ID NO: 426378 - DNA, 825 bp, Homo sapiens
  misc_feature (760)..(760): n is a, c, g, or t
  misc_feature (771)..(771): n is a, c, g, or t
tgagagttaaaccgaagggaatggtagagacggcaaccccgggcctgtgcccagctgaaggatgaactgagggcaggatcgttaaatgcagaagccgaagacagtggcctgggagaatctgggtccagagatgtcagctcttggaactgctttttcaagagaaggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaagcctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttgggnttccttcactnggccccaagggagaacgaaatcaggttcacttgttttcagaaaccacaagtttc

SEQ ID NO: 426379 - DNA, 677 bp, Homo sapiens
actgacccatgtctaaataattcttataaaatgcttattgtataaagctgaattttatatcattacattgactcagtttatattaatacattgagattaatatttcaaacaatagcatctagttattgtgatggtaaaatgaattttcatatttgctgtgtcgacactagacattttttatggtctcactcaagctttctgaatgctgattcttaacatcaactggggtgtacatttgttatttcggccttttaatggaagtgttcacagagccataattatagaggaacaaacaccactatagcctcctttattggcattcacaggattccgataagtcagcaagtgtcttccattgagaaggaaggaaactacactatgtctttccaaaatactgtttgtcgttaatgtcagaactgatgaacaatgatttctgaccacaataaagctttaaaatacctcacagcttcacaacagggtgttctatagaaagttacctttgttgttgcattttactttgatgtctctgaattaaataaatagtcacgaatggtgcagctaacatgtttctaattgatcatgaatgtagacatggaaaattaaaggatttctaaaattcgtaccagtttactgtaacaaaagtcagcaggtcatgtttaggtcatcatttcaaaggc

SEQ ID NO: 426380 - DNA, 6732 bp, Homo sapiens
  misc_feature (620)..(620): n is a, c, g, or t
cagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccnaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatggtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagcagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaagcctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgat

SEQ ID NO: 426381 - DNA, 6750 bp, Homo sapiens
  misc_feature (620)..(620): n is a, c, g, or t
cagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccnaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagcagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaagcctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgat

SEQ ID NO: 426382 - DNA, 3604 bp, Homo sapiens
tgagagttaaaccgaagggaatggtagagacggcaaccccgggcctgtgcccagctgaaggatgaactgagggcaggatcgttaaatgcagaagccgaagacagtggcctgggagaatctgggtccagagatgtcagctcttggaactgctttttcaagagaaggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaagcctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgat

SEQ ID NO: 426383 - DNA, 4367 bp, Homo sapiens
  misc_feature (620)..(620): n is a, c, g, or t
cagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccnaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagcagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaagcctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcaggtaactttaaaaatattcttttatattaatatataaagggccttccattgaaaagctgaacttatgtttcaaatgtcagacatttggggccgggtgtggtggctcacgcctgtaatcccagcactttgggaggtcaaggcaggtggatcacttgagctcaggagttcaagaccagcctgaccaacatggggaaaccccgtctttactaaaaagacaaaaattagctgggtgtggtggcttgtgtctataagctcagctactcaggaagctgaggcaggagaattgcttgaaccccaagaggcagatgttggagtgagccgagatcgcaccactgcactccagcctgagtgacagagactctgtctcaaaaaaaaaaa

SEQ ID NO: 426384 - DNA, 3537 bp, Homo sapiens
  misc_feature (620)..(620): n is a, c, g, or t
cagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccnaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagcagcgtacattggatccatgcggcctctgaaaatggtaaaaatgaaatccaaatgtccttgtggtgattctttgtcagcttgacgtggtaattcacagggtgtgactttgaagcaataaagctgacttttaagaaacaaatttgtagtagattggacctattgctcaatagaaatcatggaaagaataacttgctagatgctatagatt

SEQ ID NO: 426385 - DNA, 3313 bp, Homo sapiens
  misc_feature (620)..(620): n is a, c, g, or t
  misc_feature (3309)..(3309): n is a, c, g, or t
cagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccnaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacattttaacacctttcttattgagaagactgaagtctgatgttgctcttgaagttcctcctaaacgagaagtancgtt

SEQ ID NO: 426386 - DNA, 398 bp, Homo sapiens
ctgggattcaacacacaaatacgctctgttcaggttattggtggcatgtgagttacctacttgttgactcaataaaatagatcattttaaaaatcaagtttgggctgggcacagtggctcacgcctgtattcccaacactttaggaggccgaggtagaaggatcatttgaatccagggattcaagaaaagcctgggcaacaaagtgagaccccatctctaccaaaaatttaaaaattagccaggtgtcgtggcacatgcctgtggccccagctacgtaggaggctgaggccgaaggatcacttgagcacagtaggttgaggctgcagtgagccgtgttcacgccactgtactccagtctgagtgacaaagcaagaccctatcttaatttaaaaaaaaa

SEQ ID NO: 426387 - DNA, 652 bp, Homo sapiens
ggaccagaatgctgacagccagttctggagcttgaagtccgatggcaggatttacagcaagttgaagccaaatttagttttagacattaaaggtaagggtcacttcctttattttctttattgtaatgtgtatgtcttttagttaaggaaaaatctattcataacttttgaaaatgatgaatgtattattagtagtaacagtaagagagcccctactgtgtgccagctgctgtgctagccactttcagtacaccatgtcccgtcatcttcacagccgccctatgaggcctacattatcccctctccctcttttctccccagttttacagacaaaacaacaacaacaacaacaacaaaaccccggaagctcaaaggggttggccagtttggccacaatctcacagctgtaactgctgaaccagaatctggccataggctgacttcaaacatttattttattataatagtgttaggctaaaaatcacaagctgaaaggccgtgattgcacttagttcggtagagttgatgattctcatgtatacacgtgacctttcattgaaaagatctaagatctcaaaggaattaacacagcctacaggatttcaatgcaacatgtgttcaatgaagctaatagggagtgaactgatggtgc

SEQ ID NO: 426388 - DNA, 343 bp, Homo sapiens
atttaacagtttatctaattattccatgagtcccccagatcttattatgtgaacttcaacacataatagtttcgtaagccctggttgcaaaatcaaataccttcaggggccaggcagcaaatacaaatggctgagagttaaaccgaagggaatggtagagacggcaaccccgggcctgtgcccagctgaaggatgaactgagggcaggatcgttaaatgcagaagccgaagacagtggcctgggagaatctgggtccagagatgtcagctcttggaactgctttttcaagagaagtatggatttttatgataaattttccaagttaaaaaaacttgctaggtc

SEQ ID NO: 426389 - DNA, 490 bp, Homo sapiens
ctaaaattcgtaccagtttactgtaacaaaagtcagcaggtcatgtttaggtcatcatttcaaaggctaaattagttaatgtgtttaggaaaataattttatgtgtttctgtttactttttcaaagattcacttgttttcagaaccacagtttcaaggtcacagtcaaagttttgaagaaacaacaagtcaaattgatgattcattttctaccaagtcttgcagagtttcaggaggcaggtaagtgaaacaaaggcctggcagagctgaatcactggagtaaaacagaattcacacatcagcaagtatatagtgatgcctgttaggtgcttggcactatgcgaaaccaccatcttagtccaatggcgtgcttcgtgatatctgagtaccagacgccagaggacacgggcttcaggttggttggagaagctgaagatcatctcattgtgtaatggaattcagagcaggttctttactctgtatgtcttccc

SEQ ID NO: 426390 - DNA, 3742 bp, Homo sapiens
aattcttactatctatgcatctatattttttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagcagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaagcctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgat

SEQ ID NO: 426391 - DNA, 2399 bp, Homo sapiens
atctcactttggattcttcctgatattcatgcttgttcagtgcttccagcagcacatctggtataacaactgctgggggttttgtcttctagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgat

SEQ ID NO: 426392 - DNA, 4572 bp, Homo sapiens
  misc_feature (620)..(620): n is a, c, g, or t
cagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccnaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagcagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaagcctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggtaaggagttatatttttgtatgagaatatttaactgaattctggatttccttaatgtgtgttcctggttcatgtaatagtaattgctatggaaaatattctgagtttatttttagcagtaattgctaataatctagaagaaaaaaactttttcaatgtgtttgttctattcatttccttttctccttcctttaaaaatttttaggattctttcactggcccaaggagacgaaatcaggtaactttaaaaatattcttttatattaatatataaagggccttccattgaaaagctgaacttatgtttcaaatgtcagacatttggggccgggtgtggtggctcacgcctgtaatcccagcactttgggaggtcaaggcaggtggatcacttgagctcaggagttcaagaccagcctgaccaacatggggaaaccccgtctttactaaaaagacaaaaattagctgggtgtggtggcttgtgtctataagctcagctactcaggaagctgaggcaggagaattgcttgaaccccaagaggcagatgttggagtgagccgagatcgcaccactgcactccagcctgagtgacagagactctgtctcaaaaaaaaaaa

SEQ ID NO: 426393 - DNA, 3328 bp, Homo sapiens
  misc_feature (1)..(1): n is a, c, g, or t
  misc_feature (6)..(6): n is a, c, g, or t
  misc_feature (8)..(8): n is a, c, g, or t
  misc_feature (15)..(15): n is a, c, g, or t
  misc_feature (17)..(17): n is a, c, g, or t
  misc_feature (2011)..(2011): n is a, c, g, or t
ntgggngngggcccncncccaccacacaattcagacaagagctttgtggccctgtgcaagaaaggacctcattattctttttaccttacaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426394 - DNA, 4134 bp, Homo sapiens
  misc_feature (9)..(10): n is a, c, g, or t
  misc_feature (40)..(40): n is a, c, g, or t
  misc_feature (77)..(77): n is a, c, g, or t
  misc_feature (2817)..(2817): n is a, c, g, or t
ccccccgcnntatccccaccctcaaatcaccgtcacgcanattacatatctaccttccctgcctcccccctcctctnccagctgccaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426395 - DNA, 4045 bp, Homo sapiens
  misc_feature (2728)..(2728): n is a, c, g, or t
gggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaaaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426396 - DNA, 4184 bp, Homo sapiens
  misc_feature (2867)..(2867): n is a, c, g, or t
gggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaaggatggtgcacagaacaaactggtgtaggagaggccagcgccagggagaatatggagtaatccaggtgtgggctgcagaagcctgaattaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426397 - DNA, 2025 bp, Homo sapiens
gggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426398 - DNA, 3889 bp, Homo sapiens
  misc_feature (2572)..(2572): n is a, c, g, or t
gggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacaaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426399 - DNA, 3213 bp, Homo sapiens
  misc_feature (1896)..(1896): n is a, c, g, or t
ttagagtgcagaagtagtctcgaggtatgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426400 - DNA, 3278 bp, Homo sapiens
  misc_feature (1961)..(1961): n is a, c, g, or t
gacccacgcgtccgtgcgctgttacactgtgcagttgcattctggccactttgaccttatagctcccaaatgatgagtttgtcatctttatgaactcatgacaggataataagcttgaagacctgctgtagttagatatgggctttaatccttcccatgcaccagtcagctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426401 - DNA, 3327 bp, Homo sapiens
  misc_feature (16)..(16): n is a, c, g, or t
  misc_feature (47)..(47): n is a, c, g, or t
  misc_feature (76)..(76): n is a, c, g, or t
  misc_feature (105)..(105): n is a, c, g, or t
  misc_feature (135)..(135): n is a, c, g, or t
  misc_feature (154)..(154): n is a, c, g, or t
  misc_feature (167)..(167): n is a, c, g, or t
  misc_feature (202)..(202): n is a, c, g, or t
  misc_feature (209)..(209): n is a, c, g, or t
  misc_feature (219)..(219): n is a, c, g, or t
  misc_feature (2010)..(2010): n is a, c, g, or t
cccaaagtatggtccnactttgtggaatgtaaagatttttaaggttngttggcccagaaaaaaaaaatacttccanaaaccccatagggttggaacccaggcggnttgtgcttttttctgaagcctatgggagtngacagagtgggaacccaanatgtttttaagantgctggacttaagaatcacgacttatagccaactnctttccncctaatgtgnctgaagggattcataatgatcacaattagcattaggtgtcatcagcgccatctgatggcgctgatgacaccagggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426402 - DNA, 3034 bp, Homo sapiens
  misc_feature (1717)..(1717): n is a, c, g, or t
aggaactcaagagggggtgggctctagactatcgagggctgagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426403 - DNA, 2863 bp, Homo sapiens
  misc_feature (1546)..(1546): n is a, c, g, or t
gcagccgctactactactaaatttgcgcccgtgcgacgtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426404 - DNA, 1640 bp, Homo sapiens
  misc_feature (323)..(323): n is a, c, g, or t
ccacgcgtcgcccacgcgtcgcccacgcgtcgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426405 - DNA, 851 bp, Homo sapiens
gggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacagtaagtttctggtgatcacgtaagggttgcttatcaatgttgccaaacaagtattttccagcccatcacgtcatattccatactgtctcacatgttatagtgctctgtttacttaataaagatgctcacatgttgattgtactaataagttatagtgctctgtttacttaataaagatgctcacacgttgattgtactaat

SEQ ID NO: 426406 - DNA, 849 bp, Homo sapiens
gggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctcagaaaagtttgatttgatctggaaacgggctcagcctggtcaacatactatgtgctcgccaaaagggaggtaatagattatgaggaaatggaaggactgagacacttactgagtataaaatagacgggggaagtgaccgcagtgataataatacgaataggagaaggtagttgactggaatgtcaatctagagaggcggtcacaattttatgtgaaatgtgggtccgtttttgagagttgttttcc

SEQ ID NO: 426407 - DNA, 1785 bp, Homo sapiens
gggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagatta

SEQ ID NO: 426408 - DNA, 4093 bp, Homo sapiens
  misc_feature (2776)..(2776): n is a, c, g, or t
gggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426409 - DNA, 3877 bp, Homo sapiens
  misc_feature (2560)..(2560): n is a, c, g, or t
ttctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426410 - DNA, 4042 bp, Homo sapiens
  misc_feature (2725)..(2725): n is a, c, g, or t
gggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacaggcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426411 - DNA, 3553 bp, Homo sapiens
  misc_feature (2236)..(2236): n is a, c, g, or t
gtgatagtggccttttgtgttttactatgtgtaggttaactttattcttttccaacctacaggcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426412 - DNA, 3770 bp, Homo sapiens
  misc_feature (2453)..(2453): n is a, c, g, or t
gggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaaaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccatgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttgacctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctntcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaaaaaaaaatt

SEQ ID NO: 426413 - DNA, 2872 bp, Homo sapiens
ccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacaggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattgcggagtatgcagtcccaggcttttcgaattagtcaaaacactggccccccaccaattgaccgtcaaaagagattatcttacccaccagttcagagcatcccaacaggaaatggtattccatcaagggacagtgaaaatacttgtcaccaaagtttcatgcagagcttacttgcccctcacctcagtgatcaggtcattgggagccagaggtcactctcagaacatcagaggaatacacagtgtggtccatcctctgcaattgaatataattgtcccccaactcatgaaaatgtccatattagaagagagagtgagagtcagaatagggaaagttgtgacatgtcgttaggtgcaattaacaccaggaacagcaccttgaatattcctttttcaagttcctcttcctcaggagatattcaaggtcgaaacacaagccccaatgtttctgtacagaaatccaatcccatgaggattactgagagtcatgccaccaagggccacatgaaccctccagtcacaaccaacatgcatggggttgcaaggccagcgttgccacatccatctgtgtctcatggaaatggcgatcaaggccctgctgtacgtcaagctaattcttcagttccccagagatcaaggcatcccctgcaagacagcagtggttccaaaattcgtcagcctgaaaggaatcgttctggaaaccaaaggcaaagtactgtctttgatccaagtcttccccatctttctctctctactggtggcagtatgattcttggacgtcaacaacctgccacagagaagagaggaagtattgttcgtttcatgcctgatagcccacaagtacctaatgataattcaggtcctgaccagcatacactatcacaaaattttggtttttcttttattcctgagggtggcatgaatccaccaataaatgctaatgcttctttcattcc

SEQ ID NO: 426414 - DNA, 8578 bp, Homo sapiens
ccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaagtgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtgggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaaagataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgagtatcgaagggaaatgcattctttttatggagtattgaccctgatcctctatgatgtcatatagagcaactcagggctatacttgctagattttaaccaagcagtttgaaatattaatcatcatcctctcatcttctccagtctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtataagagtagctcacaacattttaaatgtttccaatatgaatcgtgttacaaaattcttaattttatatttcatataaattaaagaggaaaaagaaaaggtttataatatattttaaaacaatgtgttactatataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataacagttcctagtaatagtattttgagttatttttctttaggtttccttatactcaaattggctaggtcctatcttttcctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatgattttctgttactttagctcattcagatcaggatggacatgctctttttgatctataactgttcagccagcttccagataatattttaggctatgagagctatacagtctctcttattactcatttctgctgttgaagtatcgaaaacagatagagatactatgtaaagaatgggcgtagctatgttccaggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatattttgttgtcttgaaagcagatacactcttcctggagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctcttgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggagcagagacttactgtctctcttccacattataaatgaactgcctttccaggtccaacatgctgtcaggttgcttcagctcggtgtgaatgtaagtgtggggatcaaacacacacacctatacacatacatattaatatgcagaggattttaaataattgcaaatgtcttgtggctgttttatttctacaaaattctgtaagatgtataccagaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccagtatgtgatttttataaattaaaggtaatattgtatattaaagttcaaataaagatgttctttaagtgaaaaaaaaaaaa

SEQ ID NO: 426415 - DNA, 8613 bp, Homo sapiens
ccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaagtgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtgggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaaagataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgagtatcgaagggaaatgcattctttttatggagtattgaccctgatcctctatgatgtcatatagagcaactcagggctatacttgctagattttaaccaagcagtttgaaatattaatcatcatcctctcatcttctccagtctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtataagagtagctcacaacattttaaatgtttccaatatgaatcgtgttacaaaattcttaattttatatttcatataaattaaagaggaaaaagaaaaggtttataatatattttaaaacaatgtgttactatataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataacagttcctagtaatagtattttgagttatttttctttaggtttccttatactcaaattggctaggtcctatcttttcctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatgattttctgttactttagctcattcagatcaggatggacatgctctttttgatctataactgttcagccagcttccagataatattttaggctatgagagctatacagtctctcttattactcatttctgctgttgaagtatcgaaaacagatagagatactatgtaaagaatgggcgtagctatgttccaggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatattttgttgtcttgaaagcagatacactcttcctggagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctcttgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggagcagagacttactgtctctcttccacattataaatgaactgcctttccaggtccaacatgctgtcaggttgcttcagctcggtgtgaatgtaagtgtggggatcaaacacacacacctatacacatacatattaatatgcagaggattttaaataattgcaaatgtcttgtggctgttttatttctacaaaattctgtaagatgtataccagaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccatagggattgtataattcagggattggctctgaggtccataagaagtctagtgaaaccgggcccaaacggggagccccccggggggggacccccaagcgggacgttagtagccccc

SEQ ID NO: 426416 - DNA, 8225 bp, Homo sapiens
ccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacaggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaagtgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtgggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaaagataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgagtatcgaagggaaatgcattctttttatggagtattgaccctgatcctctatgatgtcatatagagcaactcagggctatacttgctagattttaaccaagcagtttgaaatattaatcatcatcctctcatcttctccagtctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtataagagtagctcacaacattttaaatgtttccaatatgaatcgtgttacaaaattcttaattttatatttcatataaattaaagaggaaaaagaaaaggtttataatatattttaaaacaatgtgttactatataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataacagttcctagtaatagtattttgagttatttttctttaggtttccttatactcaaattggctaggtcctatcttttcctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatgattttctgttactttagctcattcagatcaggatggacatgctctttttgatctataactgttcagccagcttccagataatattttaggctatgagagctatacagtctctcttattactcatttctgctgttgaagtatcgaaaacagatagagatactatgtaaagaatgggcgtagctatgttccaggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatattttgttgtcttgaaagcagatacactcttcctggagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctcttgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggagcagagacttactgtctctcttccacattataaatgaactgcctttccaggtccaacatgctgtcaggttgcttcagctcggtgtgaatgtaagtgtggggatcaaacacacacacctatacacatacatattaatatgcagaggattttaaataattgcaaatgtcttgtggctgttttatttctacaaaattctgtaagatgtataccagaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccagtatgtgatttttataaattaaaggtaatattgtatattaaagttcaaataaagatgttctttaagtgaaaaaaaaaaaa

SEQ ID NO: 426417 - DNA, 6283 bp, Homo sapiens
ccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaagtgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtgggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaaagataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgagtatcgaagggaaatgcattctttttatggagtattgaccctgatcctctatgatgtcatatagagcaactcagggctatacttgctagattttaaccaagcagtttgaaatattaatcatcatcctctcatcttctccagtctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtataagagtagctcacaacattttaaatgtttccaatatgaatcgtgttacaaaattcttaattttatatttcatataaattaaagaggaaaaagaaaaggtttataatatattttaaaacaatgtgttactatataatacaactataattgtagttaataactaaaacctcttgaaaatgtcaaagaaatacttgatttctgatgcaactttgactaaaatatttactttagaaataaaaacgttcttattttgctatatca

SEQ ID NO: 426418 - DNA, 7709 bp, Homo sapiens
attctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaagtgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtgggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaaagataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgagtatcgaagggaaatgcattctttttatggagtattgaccctgatcctctatgatgtcatatagagcaactcagggctatacttgctagattttaaccaagcagtttgaaatattaatcatcatcctctcatcttctccagtctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtataagagtagctcacaacattttaaatgtttccaatatgaatcgtgttacaaaattcttaattttatatttcatataaattaaagaggaaaaagaaaaggtttataatatattttaaaacaatgtgttactatataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataacagttcctagtaatagtattttgagttatttttctttaggtttccttatactcaaattggctaggtcctatcttttcctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatgattttctgttactttagctcattcagatcaggatggacatgctctttttgatctataactgttcagccagcttccagataatattttaggctatgagagctatacagtctctcttattactcatttctgctgttgaagtatcgaaaacagatagagatactatgtaaagaatgggcgtagctatgttccaggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatattttgttgtcttgaaagcagatacactcttcctggagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctcttgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggagcagagacttactgtctctcttccacattataaatgaactgcctttccaggtccaacatgctgtcaggttgcttcagctcggtgtgaatgtaagtgtggggatcaaacacacacacctatacacatacatattaatatgcagaggattttaaataattgcaaatgtcttgtggctgttttatttctacaaaattctgtaagatgtataccagaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccagtatgtgatttttataaattaaaggtaatattgtatattaaagttcaaataaagatgttctttaagtgaaaaaaaaaaaa

SEQ ID NO: 426419 - DNA, 7340 bp, Homo sapiens
cttctgctgcttcctgcttctgccgcttcctgcttctgcccctgcttcctgcttctgccgtcatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaagtgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtgggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaaagataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgagtatcgaagggaaatgcattctttttatggagtattgaccctgatcctctatgatgtcatatagagcaactcagggctatacttgctagattttaaccaagcagtttgaaatattaatcatcatcctctcatcttctccagtctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtataagagtagctcacaacattttaaatgtttccaatatgaatcgtgttacaaaattcttaattttatatttcatataaattaaagaggaaaaagaaaaggtttataatatattttaaaacaatgtgttactatataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataacagttcctagtaatagtattttgagttatttttctttaggtttccttatactcaaattggctaggtcctatcttttcctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatgattttctgttactttagctcattcagatcaggatggacatgctctttttgatctataactgttcagccagcttccagataatattttaggctatgagagctatacagtctctcttattactcatttctgctgttgaagtatcgaaaacagatagagatactatgtaaagaatgggcgtagctatgttccaggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatattttgttgtcttgaaagcagatacactcttcctggagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctcttgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggagcagagacttactgtctctcttccacattataaatgaactgcctttccaggtccaacatgctgtcaggttgcttcagctcggtgtgaatgtaagtgtggggatcaaacacacacacctatacacatacatattaatatgcagaggattttaaataattgcaaatgtcttgtggctgttttatttctacaaaattctgtaagatgtataccagaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccagtatgtgatttttataaattaaaggtaatattgtatattaaagttcaaataaagatgttctttaagtgaaaaaaaaaaaa

SEQ ID NO: 426420 - DNA, 6792 bp, Homo sapiens
gcagtatgtactgcttaggttatgggtgcaccaaaatctctcaaatcactgctaaagaacttactcatgtaaccaaataccacctgtaccccagtaacttatggaaaaaaatgaatgacagcagagtcctcatcagaaccaatattcctcctgaacatagatagaactaaacaagattttgacaaatcaactctaacaacaaattacatagataatatgttatgactaaatgggtttatcccaggtgtggagggttgatttaatgtttgaaaatcaatgaactaaaatagaccacctcagtagacagaaaaattatttggcaaaatccaacacccatttctgataaaaactctcagcaaactgggaatagaaggaaacttcttaccctgataagggcatatatgaaaaacctacagctaacatcatattgaaaaactgaatgtgttgctcttaagattaggaacaagacaaaggtgtctgctctcttcaccacacctggccggatttttttttaaactgttttatttcagtaggtctagttgttcatcttactggatttcttatacactattctgaaacctcttgtctttgtgtttagatcatttgggtgtctgaggtttatttctttgatgtttttcatcaaagctgctcaaaatacgttattggttttctgtgccattaaaagtgagctcacttcatgttcttgttgaattctaactgaagctcatttctcccctttttattttcagatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaagtgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtgggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaaagataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgagtatcgaagggaaatgcattctttttatggagtattgaccctgatcctctatgatgtcatatagagcaactcagggctatacttgctagattttaaccaagcagtttgaaatattaatcatcatcctctcatcttctccagtctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtataagagtagctcacaacattttaaatgtttccaatatgaatcgtgttacaaaattcttaattttatatttcatataaattaaagaggaaaaagaaaaggtttataatatattttaaaacaatgtgttactatataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataacagttcctagtaatagtattttgagttatttttctttaggtttccttatactcaaattggctaggtcctatcttttcctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatgattttctgttactttagctcattcagatcaggatggacatgctctttttgatctataactgttcagccagcttccagataatattttaggctatgagagctatacagtctctcttattactcatttctgctgttgaagtatcgaaaacagatagagatactatgtaaagaatgggcgtagctatgttccaggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatattttgttgtcttgaaagcagatacactcttcctggagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctcttgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggagcagagacttactgtctctcttccacattataaatgaactgcctttccaggtccaacatgctgtcaggttgcttcagctcggtgtgaatgtaagtgtggggatcaaacacacacacctatacacatacatattaatatgcagaggattttaaataattgcaaatgtcttgtggctgttttatttctacaaaattctgtaagatgtataccagaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccagtatgtgatttttataaattaaaggtaatattgtatattaaagttcaaataaagatgttctttaagtgaaaaaaaaaaaa

SEQ ID NO: 426421 - DNA, 6426 bp, Homo sapiens
ccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgagtatcgaagggaaatgcattctttttatggagtattgaccctgatcctctatgatgtcatatagagcaactcagggctatacttgctagattttaaccaagcagtttgaaatattaatcatcatcctctcatcttctccagtctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtataagagtagctcacaacattttaaatgtttccaatatgaatcgtgttacaaaattcttaattttatatttcatataaattaaagaggaaaaagaaaaggtttataatatattttaaaacaatgtgttactatataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataacagttcctagtaatagtattttgagttatttttctttaggtttccttatactcaaattggctaggtcctatcttttcctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatgattttctgttactttagctcattcagatcaggatggacatgctctttttgatctataactgttcagccagcttccagataatattttaggctatgagagctatacagtctctcttattactcatttctgctgttgaagtatcgaaaacagatagagatactatgtaaagaatgggcgtagctatgttccaggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatattttgttgtcttgaaagcagatacactcttcctggagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctcttgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggagcagagacttactgtctctcttccacattataaatgaactgcctttccaggtccaacatgctgtcaggttgcttcagctcggtgtgaatgtaagtgtggggatcaaacacacacacctatacacatacatattaatatgcagaggattttaaataattgcaaatgtcttgtggctgttttatttctacaaaattctgtaagatgtataccagaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccagtatgtgatttttataaattaaaggtaatattgtatattaaagttcaaataaagatgttctttaagtgaaaaaaaaaaaa

SEQ ID NO: 426422 - DNA, 3045 bp, Homo sapiens
  misc_feature (30)..(30): n is a, c, g, or t
attcctagagtctccccacgtaatatgtanccttgtgggttgcacattttgtatctctctaacatcagcgtattcctgactttaagcaggtgtttatatgtaaaataaaacctgagtatcgaagggaaatgcattctttttatggagtattgaccctgatcctctatgatgtcatatagagcaactcagggctatacttgctagattttaaccaagcagtttgaaatattaatcatcatcctctcatcttctccagtctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtataagagtagctcacaacattttaaatgtttccaatatgaatcgtgttacaaaattcttaattttatatttcatataaattaaagaggaaaaagaaaaggtttataatatattttaaaacaatgtgttactatataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataacagttcctagtaatagtattttgagttatttttctttaggtttccttatactcaaattggctaggtcctatcttttcctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatgattttctgttactttagctcattcagatcaggatggacatgctctttttgatctataactgttcagccagcttccagataatattttaggctatgagagctatacagtctctcttattactcatttctgctgttgaagtatcgaaaacagatagagatactatgtaaagaatgggcgtagctatgttccaggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatattttgttgtcttgaaagcagatacactcttcctggagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctcttgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggagcagagacttactgtctctcttccacattataaatgaactgcctttccaggtccaacatgctgtcaggttgcttcagctcggtgtgaatgtaagtgtggggatcaaacacacacacctatacacatacatattaatatgcagaggattttaaataattgcaaatgtcttgtggctgttttatttctacaaaattctgtaagatgtataccagaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccagtatgtgatttttataaattaaaggtaatattgtatattaaagttcaaataaagatgttctttaagtgaaaaaaaaaaaa

SEQ ID NO: 426423 - DNA, 3626 bp, Homo sapiens
  misc_feature (3410)..(3410): n is a, c, g, or t
  misc_feature (3497)..(3497): n is a, c, g, or t
ccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaattagcctcctaccatgagagaactgtttttccagctggatgaaaagagtagcatcaagtcccctattctgctgttttctgctcacttactcctggagacaagctaagtcaaatcaatatgtacttataagtacctgctttctcagagttgtatttgagaattaaagtatatgaaatgtatactctacccataaatagcttggagtctggtttagaaatctcttacctttaggcatggacaaatttaataaaagtacaaagtatatatgcagttggccctccatgtcaatgggttcatggattcaaccaaacatggattgaagatatagttttttaaaaattacatctgttttgagcatgtatatacctttttcttgtcattattccctaggcaatataacaactatttacatagatttaaagtatgtgggagcatatgcattggttatatgaatatactataccattttatatcaaggatttgagcattcaaggatttttgtatctgcgagaggtcctggaaccaatcccccatagatactgagggacaactgtattcagtgctaaatagaaaataaatgttttagaaattcagagaagggaattttggtgcaggccagagtagtcatgaagaaagactaaaatgatgctgaattagtaagatgttaataggtggggtaaaacagaaagtagctttgtgaaaagaaggattcagcctgaaaaaatacctttaaaaaaacactaaagaaactagaccgactaaagtacattcactaggagaagtagtaggaaataagagctctagaatcaaaatcagggaagcagcatggatgacccttgaggacattatgctaagtgaaataagtcagccataanaagacaaatatggggtgattccacttctatgaggtctctaaagtagtcacatttatggaaacaaagtagaatgttggttaccagggncctggggaggggaatggaaatgagttttagttttgcaaagaacagtgtgaatatacttaatactactgaactatacgctgaaaaatggtgaagatggtaaactttatgtcatgtgtttattaccacaat

SEQ ID NO: 426424 - DNA, 2050 bp, Homo sapiens
ccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtgtaagtattctagtatacctgaggctttcttaaaaaattatttgtctgaaaactctttgcttgatgttgtaaaaagtacactacgtggagttagaaaccctcagtgtctaaccttgtggtctgctggtgctgttcttagg

SEQ ID NO: 426425 - DNA, 5443 bp, Homo sapiens
ccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaagtgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtgggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaaagataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgaacacaaaaaaaaacacacacaacacacaccccaacccacccaaccactatacatattcctcacgatccaccattactacaaacaaaaataataatagataaacaaatcacaaaacatacttaacaccacactcatatctttcctagcaatctctgccttacacaacatatgaaaaaagacaagaacatgagtgggacggggcgcgacgacgaggcagatagcactaacgagggagcagatgatgccgtctagacgacagaggtaggaagagaagcagaagctaggtggggcccgcacggagaatgacacgaccagggggcagcaaagggttggtgtgaaacaagcctaggcaggggcacaagagagaaccagcgggagc

SEQ ID NO: 426426 - DNA, 3609 bp, Homo sapiens
ccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaagtgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactc

SEQ ID NO: 426427 - DNA, 1800 bp, Homo sapiens
  misc_feature (1736)..(1736): n is a, c, g, or t
  misc_feature (1777)..(1777): n is a, c, g, or t
  misc_feature (1779)..(1779): n is a, c, g, or t
ccctgacagacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaaganatgaagataaaagagacaagccactgccaccagtccctatncncaaccttgtaggaatacgtgg

SEQ ID NO: 426428 - DNA, 1649 bp, Homo sapiens
  misc_feature (39)..(39): n is a, c, g, or t
  misc_feature (43)..(43): n is a, c, g, or t
  misc_feature (47)..(48): n is a, c, g, or t
  misc_feature (52)..(52): n is a, c, g, or t
cctccctctctaagaagcattgctggtcgaggctggttnaatnggcnnaggncggccccctggcccggccacctgggaccgtgctggggagtctgccacttccctctctcccctggcccgcaaagttttggcggagccatcgctggggctgagcgcgcccccggggggagatcggggagcgcccgatgccgggcggccggagccattgacccgggacgccgccgtccgctgagcagccgaccaccccgccgcctccggtgcatggggactggctgaggagccagcatgggcaactgcgtggggagacagcgccgggagaggccggcagccccgggacacccccgcaagcgagcaggacgcaatgagcccctgaagaaagagcggcttaagtggaagagcgactaccccatgactgacgggcagctgcggagcaaacgggatgagttctgggacacagcgcctgccttcgagggccgcaaggagatctgggatgccctcaaggctgccgcctatgctgctgaagccaacgaccacgagctggcccaggccatcctggatggagccagcatcaccctgcctcatggcaccctctgtgaatgctacgatgagctgggcaatcgctaccagctgcccatctactgcctgtcaccgccggtgaacctgctgctggagcacacggaggaggagagcctggagccccccgagcctccacccagcgtgcgccgtgagttcccgctgaaggtgcgcctgtccacgggcaaggacgtgaggctcagcgccagcctgcccgacacagtggggcagctcaagaggcagctgcacgcccaggagggcatcgagccatcgtggcagcggtggttcttctccgggaagctgctcacagaccgcacacggctccaggagaccaagatccagaaagattttgtcatccaggtcatcatcaaccagcccccaccaccccaggactgatgggcccacggacccctgggaagaggccccgcctggagcactaggcccccaccctgctgctgccttccagtgctgtcattttcttcaggggccctcccctcggtgtggctggtgggtgagccgtgaagggaccctgcctttcagggcactacgcgccaccagttcccggtacccagggagcaggcagccacacacgggccttgcaaccttgtcagagaaaaggcgaacagggccctcaccctgcctgtctcccgaagcaggttcgagccacaagggccaaccaggaggcccctggagcccagatctgtcatctggtgctgccagctgtgctcactctggttttctgctcagggtctgaagcagctgctgtctccctcctctgcccccatcccctggctctcccctgggcacagtgccactcccttggaagggagggaaccacccgtgagccccagggcttgggaagcctgaggcgggcctctgcctctccctgcccccagcacaattggcagagatgaggcgggtggtggacggctgggctgtcgtggcagggtctgcacagggccatgtcctggctgtaacccaggcagtgggaggtctgcagcctggtcatggcctccacagcaggtccctgtggacagacatatctgcatatttatcaataaagccttttgctcctt

SEQ ID NO: 426429 - DNA, 1108 bp, Homo sapiens
tctctccgcccctccagcggagctggtctccggccgggcaccgtcgcgggcccccctggcccggccacctgggaccgtgctggggagtctgccacttccctctctcccctggcccgcaaagttttggcggagccatcgctggggctgagcgcgcccccggggggagatcggggagcgcccgatgccgggcggccggagccattgacccgggacgccgccgtccgctgagcagccgaccaccccgccgcctccggtgcatggggactggctgaggagccagcatgggcaactgcgtggggagacagcgccgggagaggccggcagccccgggacacccccgcaagcgagcaggacgcaatgagcccctgaagaaagagcggcttaagtggaagagcgactaccccatgactgacgggcagctgcggagcaaacgggatgagttctgggacacagcgcctgccttcgagggccgcaaggagatctgggatgccctcaaggctgccgcctatgctgctgaagccaacgaccacgagctggcccaggccatcctggatggagccagcatcaccctgcctcatggcaccctctgtgaatgctacgatgagctgggcaatcgctaccagctgcccatctactgcctgtcaccgccggtgaacctgctgctggagcacacggaggaggagagcctggagccccccgagcctccacccagcgtgcgccgtgagttcccgctgaaggtgcgcctgtccacgggcaaggacgtgaggctcagcgccagcctgcccgacacagtggggcagctcaagaggcagctgcacgcccaggagggcatcgagccatcgtggcagcggtggttcttctccgggaagctgctcacagaccgcacacggctccaggagaccaagatccagaaagattttgtcatccaggtcatcatcaaccagcccccaccaccccaggactgatgggcccacggacccctgggaagaggccccgcctggagcactaggcccccaccccatggcttccatcttttgcatcacgaccactcctgaacccccagtttctgatttgtcagaatttttttttaacaaaactaaaaatgaaa

SEQ ID NO: 426430 - DNA, 1645 bp, Homo sapiens
tctctccgcccctccagcggagctggtctccggccgggcaccgtcgcgggcccccctggcccggccacctgggaccgtgctggggagtctgccacttccctctctcccctggcccgcaaagttttggcggagccatcgctggggctgagcgcgcccccggggggagatcggggagcgcccgatgccgggcggccggagccattgacccgggacgccgccgtccgctgagcagccgaccaccccgccgcctccggtgcatggggactggctgaggagccagcatgggcaactgcgtggggagacagcgccgggagaggccggcagccccgggacacccccgcaagcgagcaggacgcaatgagcccctgaagaaagagcggcttaagtggaagagcgactaccccatgactgacgggcagctgcggagcaaacgggatgagttctgggacacagcgcctgccttcgagggccgcaaggagatctgggatgccctcaaggctgccgcctatgctgctgaagccaacgaccacgagctggcccaggccatcctggatggagccagcatcaccctgcctcatggcaccctctgtgaatgctacgatgagctgggcaatcgctaccagctgcccatctactgcctgtcaccgccggtgaacctgctgctggagcacacggaggaggagagcctggagccccccgagcctccacccagcgtgcgccgtgagttcccgctgaaggtgcgcctgtccacgggcaaggacgtgaggctcagcgccagcctgcccgacacagtggggcagctcaagaggcagctgcacgcccaggagggcatcgagccatcgtggcagcggtggttcttctccgggaagctgctcacagaccgcacacggctccaggagaccaagatccagaaagattttgtcatccaggtcatcatcaaccagcccccaccaccccaggactgatgggcccacggacccctgggaagaggccccgcctggagcactaggcccccaccctgctgctgccttccagtgctgtcattttcttcaggggccctcccctcggtgtggctggtgggtgagccgtgaagggaccctgcctttcagggcactacgcgccaccagttcccggtacccagggagcaggcagccacacacgggccttgcaaccttgtcagagaaaaggcgaacagggccctcaccctgcctgtctcccgaagcaggttcgagccacaagggccaaccaggaggcccctggagcccagatctgtcatctggtgctgccagctgtgctcactctggttttctgctcagggtctgaagcagctgctgtctccctcctctgcccccatcccctggctctcccctgggcacagtgccactcccttggaagggagggaaccacccgtgagccccagggcttgggaagcctgaggcgggcctctgcctctccctgcccccagcacaattggcagagatgaggcgggtggtggacggctgggctgtcgtggcagggtctgcacagggccatgtcctggctgtaacccaggcagtgggaggtctgcagcctggtcatggcctccacagcaggtccctgtggacagacatatctgcatatttatcaataaagccttttgctcctt

SEQ ID NO: 426431 - DNA, 1591 bp, Homo sapiens
aggcatagtacgagccgggtgggcaatcggccgaggctgccttccctctctcccctggcccgcaaagttttggcggagccatcgctggggctgagcgcgcccccggggggagatcggggagcgcccgatgccgggcggccggagccattgacccgggacgccgccgtccgctgagcagccgaccaccccgccgcctccggtgcatggggactggctgaggagccagcatgggcaactgcgtggggagacagcgccgggagaggccggcagccccgggacacccccgcaagcgagcaggacgcaatgagcccctgaagaaagagcggcttaagtggaagagcgactaccccatgactgacgggcagctgcggagcaaacgggatgagttctgggacacagcgcctgccttcgagggccgcaaggagatctgggatgccctcaaggctgccgcctatgctgctgaagccaacgaccacgagctggcccaggccatcctggatggagccagcatcaccctgcctcatggcaccctctgtgaatgctacgatgagctgggcaatcgctaccagctgcccatctactgcctgtcaccgccggtgaacctgctgctggagcacacggaggaggagagcctggagccccccgagcctccacccagcgtgcgccgtgagttcccgctgaaggtgcgcctgtccacgggcaaggacgtgaggctcagcgccagcctgcccgacacagtggggcagctcaagaggcagctgcacgcccaggagggcatcgagccatcgtggcagcggtggttcttctccgggaagctgctcacagaccgcacacggctccaggagaccaagatccagaaagattttgtcatccaggtcatcatcaaccagcccccaccaccccaggactgatgggcccacggacccctgggaagaggccccgcctggagcactaggcccccaccctgctgctgccttccagtgctgtcattttcttcaggggccctcccctcggtgtggctggtgggtgagccgtgaagggaccctgcctttcagggcactacgcgccaccagttcccggtacccagggagcaggcagccacacacgggccttgcaaccttgtcagagaaaaggcgaacagggccctcaccctgcctgtctcccgaagcaggttcgagccacaagggccaaccaggaggcccctggagcccagatctgtcatctggtgctgccagctgtgctcactctggttttctgctcagggtctgaagcagctgctgtctccctcctctgcccccatcccctggctctcccctgggcacagtgccactcccttggaagggagggaaccacccgtgagccccagggcttgggaagcctgaggcgggcctctgcctctccctgcccccagcacaattggcagagatgaggcgggtggtggacggctgggctgtcgtggcagggtctgcacagggccatgtcctggctgtaacccaggcagtgggaggtctgcagcctggtcatggcctccacagcaggtccctgtggacagacatatctgcatatttatcaataaagccttttgctcctt

SEQ ID NO: 426432 - DNA, 1660 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 426433 - DNA, 1609 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 426434 - DNA, 1699 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaaaaacaccacaaagcagcaaacacagccataagacctcaacacacaaggtgttgccgcctcgtggccgagaagttttcacc

SEQ ID NO: 426435 - DNA, 1751 bp, Homo sapiens
  misc_feature (1638)..(1638): n is a, c, g, or t
  misc_feature (1642)..(1643): n is a, c, g, or t
  misc_feature (1646)..(1647): n is a, c, g, or t
  misc_feature (1653)..(1653): n is a, c, g, or t
  misc_feature (1655)..(1655): n is a, c, g, or t
  misc_feature (1658)..(1658): n is a, c, g, or t
  misc_feature (1662)..(1662): n is a, c, g, or t
  misc_feature (1664)..(1665): n is a, c, g, or t
  misc_feature (1678)..(1678): n is a, c, g, or t
  misc_feature (1680)..(1680): n is a, c, g, or t
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaaaaaaaaaaaggggggggcnaaannccnnggggcnanttnggtncnntttgtaaagggcnanagggggttaaaagggggggtaaggggggaaggcgggctggggaccttgggtaggacacgaagggaaaaggg

SEQ ID NO: 426436 - DNA, 1393 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctg

SEQ ID NO: 426437 - DNA, 1538 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagagatccacatctctcgctcaactgttaatgtctcaacctccagaggcaccccacccagcacactgtcagtaaaggggcagattgaaacagtgagagttaagggtacgcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctg

SEQ ID NO: 426438 - DNA, 1676 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaaggtaagaagtgctgtttcccacttttggctttttaaacaatgaataaattataattccctacctcagaatcattcaaagaaaggccgtatttaatgatccaaactgaaaccattaccactgttacgggcttgcttaaaggcataaagcacagttttctgcgttaataggagtgtgttttccatttggtcagtgaggcacgggaagtcagagatgttgctctgagaagcctcatgtccgaagggggtttggcagcagcctcgtgaacatgcggttcatgcggcacacagcggggatgagtttgggccctggcagcactgccccactatgggaggaatttgggaaggggcttctgacttcatctaactggatttcgcaggccagtctgaggtctaataataataatataataatgccagcaggtaatattagcatttataaggcccttatagtatggcagataaggttgattgctttactcatatgaccttcacatcaactctgttgaagtagatacaaatatcctgttttgcagatgaggaaactgaggtacagaattcttagggaacttacccaaaatggcttttctgcactctgccctttggtattgtccca

SEQ ID NO: 426439 - DNA, 1247 bp, Homo sapiens
  misc_feature (1234)..(1234): n is a, c, g, or t
  misc_feature (1240)..(1240): n is a, c, g, or t
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagagcacagctgaatctgtagatcggggagatgatttctgttggggtgatttatgtatcncttggncactttt

SEQ ID NO: 426440 - DNA, 1506 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaaggtaagtcttaccaaaaaaagatttcaaaagccttcaaattctgcttacagtaaatgctggcattgcaatggctcgcgcagaacgcgcgcggtagtaacccggggattgggaatctttgctcctccacgcttgtttttagatgcctgttgcagacgttcctctctctctgtcccccctacccactccgtcctcatcgatctcttaatgttactttctctccagtgacgcggtttcccttctttttgaactcattctcgctggaatgttttccacccccaacaacaagaagcaaaagcggctttccattccgaaagggagtttcctctttgcaaactgccaggttgcgaattagtgtgaagggaaaacagcgagaggagaaaaacaagtacaagcgtaaggagagggaagaaaataaatcaggcaaatgttgggattattcccatgcggctgtactcgcgggctgggtgcgctgcggtggctcctaggctaagggaaagagaaagccatgtttaaaatagcgctcaccctcctgctcgcctccgctgcagacccgtatgtaccaactccagtgtca

SEQ ID NO: 426441 - DNA, 1705 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgtatttgtgtaatttaaattatctttgcagaaacctgctccaccaaaacctgaacccaaaccaagaaaaacatctgctaaggtaagaagtgctgtttcccacttttggctttttaaacaatgaataaattataattccctacctcagaatcattcaaagaaaggccgtatttaatgatccaaactgaaaccattaccactgttacgggcttgcttaaaggcataaagcacagttttctgcgttaataggagtgtgttttccatttggtcagtgaggcacgggaagtcagagatgttgctctgagaagcctcatgtccgaagggggtttggcagcagcctcgtgaacatgcggttcatgcggcacacagcggggatgagtttgggccctggcagcactgccccactatgggaggaatttgggaaggggcttctgacttcatctaactggatttcgcaggccagtctgaggtctaataataataatataataatgccagcaggtaatattagcatttataaggcccttatagtatggcagataaggttgattgctttactcatatgaccttcacatcaactctgttgaagtagatacaaatatcctgttttgcagatgaggaaactgaggtacagaattcttagggaacttacccaaaatggcttttctgcactctgccctttggtattgtccca

SEQ ID NO: 426442 - DNA, 2208 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 426443 - DNA, 2382 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaaaaaaaaaaaaaaaaaaaacttgagggggggccccgtacccaaatcggcctatagtgaagtcgtttacaatttacttgccggccgtttacaacgttctgacttgggaaaccctgcggtacccaatttaatgccttgaagacaatcccccttttgcaagttggcgtaataactgca

SEQ ID NO: 426444 - DNA, 2697 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaaggaacttttcttcatctgggcttcatttccctgcaccttcccagctttctagtcatgcaagccacatgtctccacgtgaggggttcattggaaagcagccacagagccaccccctggctgggttcttccccagctctgcttcctccttccccaagtcctgcagctgctctctccatggcagaaccacttctccccttactggaggggaggtccactgaacaaatccaggagaggaatcattgtgttttccacagaagagaaagtacactggactttctgtgcaacctgttactacattttcacagagactcatatttgtgcagtgtaactcagttgaaacccagcaaaattaggctcccgtgtctccataaaggccaccatgatggtaacggttgtacttcaccttgtgtttggacagaggctgattgattttagccatcatcacaccgtgtctaacattctctttcactgtgctttgatcctctgttagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 426445 - DNA, 2264 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaaactgatgcggccggaacactcatatattttaaatatttccataatataccaactaa

SEQ ID NO: 426446 - DNA, 2149 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtactttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 426447 - DNA, 2196 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaaaaggatgcggccgaaaccccctcttctcacttgttaattctacgcattcttcaat

SEQ ID NO: 426448 - DNA, 1324 bp, Homo sapiens
attcaacaaagtaaggtatattaagaatagatttttaaaaatcaacttcgttttatataatcaccaaaaaatatgtatattttcccattccctttgtagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 426449 - DNA, 2218 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagacaagtaaaccttttattttaaaccacaaatagtcagcaggtggccacaactatccatgtttcattaaaatcacataaaacctaggtacaaaagcaccactgattattgctctagaaaaactgcatgaaaagtcgacg

SEQ ID NO: 426450 - DNA, 1982 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctg

SEQ ID NO: 426451 - DNA, 654 bp, Homo sapiens
ttagagggctccaagctcccaacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 426452 - DNA, 1434 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctg

SEQ ID NO: 426453 - DNA, 1764 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagagatccacatctctcgctcaactgttaatgtctcaacctccagaggcaccccacccagcacactgtcagtaaaggggcagattgaaacagtgagagttaagggtacgcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 426454 - DNA, 2088 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 426455 - DNA, 1301 bp, Homo sapiens
aaccggcgagagccttgtcttgaagcagagcttcctgcatggcatcaccctgctaagtgagatcgcagagctggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 426456 - DNA, 1619 bp, Homo sapiens
agtaaatctggtctcataaaatgaattcagaaatatttttgcaatgctcattttatgccttgcagaactttgagaaatattacgcataaagtgtaacatgacgggtgtcattcaaatatatgtctcaaatataaaataatcagtttttgccttgttctttcttttcctaatttccgtaacaaacatgtcctattcgtcttcacatctagtttgaagttagctgaattagtgagtgatttataatcacagatttcagaaaattagagctaagtgattttagggactgttgtcactatatatctagggggggaaactgaggcctttagaagttgccacgctcttccagtacagagtaccttcccacgctttacagattcccaccatgtaacattcattaaaagcctttatgggtaggaaatgaataaggtacctgctgtgtatatatttacattataaagtttacgtattcattcttactctttttccttcctatgaagacacacactgttcttattcttacaatctcaaagagagagcagcgaaacaatgaaacttcaggattgtgtggcctggaggctactagttgaactgggcatgctcagtcgccaggcagatttttttcggtgaagtggaaactacaacagcgcgtaccgcgcgcggaggtgggcgtgccctcgtggaatttagaacgttgcctcagccaatggggcctcgcggccggctggcggggctcctcattggagcagcagggaggcgagcagagggcccccagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 426457 - DNA, 602 bp, Homo sapiens
taattaccatgatgtaattgtaaaaaaaattggtttagatattttagagattataaaaacatggttgggctaaagaagaccttccattctgtttcttgggaagttacaacatttaccgcttactcattttaaatgttaacaacatgcactttataaactgataaaagaaatttaggtttgaataagatttcctaagtttatgaaatcctttttttctaaattattacaatatcaaaaattttaaattctgttgaattacatcaagctatgcattttcaggttttccgaacctcaaggcatttacttttagaggatgtgaatttacaacttactttgtggaaatgtgccacttactgatatacagatttaaaattaacagtatatcatttcattatctcctaacatatcaacatggataatgtagtttcaccgcgtgttaataagcttgaactccttaatagtttcagggtatattaagaacttaagtttctatcttgttgaaaattagcttacaaaacattgtagcatgacatgtctctaaaggtaattgtatgtgcatccccatttctgttgttgaataaagaaaaactaaacatcaaaaa

SEQ ID NO: 426458 - DNA, 910 bp, Homo sapiens
  misc_feature (505)..(505): n is a, c, g, or t
  misc_feature (509)..(509): n is a, c, g, or t
gttagaatgttaattttacccatgtatatatattcattgaaacctgtttcccaaaatgaaatcactcatttaaaagcaaacaactggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaaaanaaanaaaaaaaaaaaaaacaatgtgtgtgggggcggcccttgcggcccctgcgagagaagagttttagagagaacccttgcggcgtgggcgccgccggggccccaggtgaggtacacgagtggaacagtgggggcaataaagggtgttcacaccagagaagagaacccgcgggaccaaggaaaaataaggagcagggagaattatctgtcgacacccattatcaacagaaccggcccccgcggaggggcaaacacgcgaaagcggattttcgtcaacaaacatctccacgagaagtggaatttctcgagagggacaacagtaaggcgagactacaccatacaacgacggagtcttcccgaggaggaatctcgccgcatatctagttttaggcccgcctctcgtga

SEQ ID NO: 426459 - DNA, 3734 bp, Homo sapiens
tggagcgggaggagcaggagatgctgccagccctcccggggccgcgctcgctcagccgccgccaccacacggagcagacgcgcgccgggagccgcgggccgggccagccgggccgccggggcccagtgcgccgcgctcgcagccggtagcgcgccagccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttg

SEQ ID NO: 426460 - DNA, 3369 bp, Homo sapiens
caagtcagcagtaacttctagtgcttacaaggaaaaggcaatcagttttaatggtggaaatgccactattttggacttcttgtagggctatgtgacagtctccagcagtggcttcctatgggattttcaagaataacctggacgatagaagatttttgcctcatatgttgtttagaatttatcacccatgtaagatgtgaatctactgaaacagaaacataaataagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttg

SEQ ID NO: 426461 - DNA, 3595 bp, Homo sapiens
tggagcgggaggagcaggagatgctgccagccctcccggggccgcgctcgctcagccgccgccaccacacggagcagacgcgcgccgggagccgcgggccgggccagccgggccgccggggcccagtgcgccgcgctcgcagccggtagcgcgccagccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttg

SEQ ID NO: 426462 - DNA, 1882 bp, Homo sapiens
tggagcgggaggagcaggagatgctgccagccctcccggggccgcgctcgctcagccgccgccaccacacggagcagacgcgcgccgggagccgcgggccgggccagccgggccgccggggcccagtgcgccgcgctcgcagccggtagcgcgccagccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatcgggttacaagatataaaggaggtttcaaggtaaagtgttacttatcgacggtatctattatgatatccattaagggcatgtgtcttg

SEQ ID NO: 426463 - DNA, 809 bp, Homo sapiens
gttagaatgttaattttacccatgtatatatattcattgaaacctgtttcccaaaatgaaatcactcatttaaaagcaaacaactggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttg

SEQ ID NO: 426464 - DNA, 408 bp, Homo sapiens
gatcaaagaaataggttgcaagaggcttgcaaagacatcctgctgtttaagaatctggatccggtaagataaatcttaataatagaaatggctttgttttttcccccagtgacagtgtcaagaactgtacagggtcttgagttttgccctctttgtaagctgatcaccctggggtgatggtaaaggcccccttgcggatgcttgaatgcacagtaggttgaactgcaggagaggaatattgagtttgggggaatatactgctgttggagcaagaagtaaagaagcctgaggtgtttgtcctgtggaagatattctctcatctctcaagatgttatctcagggctacaaaaacagccctgagaaatggcacaggtaaaaagatggtaggaacttgccctcttcgtaccc

SEQ ID NO: 426465 - DNA, 3835 bp, Homo sapiens
  misc_feature (3430)..(3430): n is a, c, g, or t
  misc_feature (3434)..(3434): n is a, c, g, or t
tggagcgggaggagcaggagatgctgccagccctcccggggccgcgctcgctcagccgccgccaccacacggagcagacgcgcgccgggagccgcgggccgggccagccgggccgccggggcccagtgcgccgcgctcgcagccggtagcgcgccagccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaaaanaaanaaaaaaaaaaaaaacaatgtgtgtgggggcggcccttgcggcccctgcgagagaagagttttagagagaacccttgcggcgtgggcgccgccggggccccaggtgaggtacacgagtggaacagtgggggcaataaagggtgttcacaccagagaagagaacccgcgggaccaaggaaaaataaggagcagggagaattatctgtcgacacccattatcaacagaaccggcccccgcggaggggcaaacacgcgaaagcggattttcgtcaacaaacatctccacgagaagtggaatttctcgagagggacaacagtaaggcgagactacaccatacaacgacggagtcttcccgaggaggaatctcgccgcatatctagttttaggcccgcctctcgtga

SEQ ID NO: 426466 - DNA, 3650 bp, Homo sapiens
tggagcgggaggagcaggagatgctgccagccctcccggggccgcgctcgctcagccgccgccaccacacggagcagacgcgcgccgggagccgcgggccgggccagccgggccgccggggcccagtgcgccgcgctcgcagccggtagcgcgccagccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccagggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttg

SEQ ID NO: 426467 - DNA, 286 bp, Homo sapiens
gcggccgcctactactactactgctcgaattcaagcttctaacgatgtacggggcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426468 - DNA, 5663 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttcaaaaaaaaaaaaaaaaaaaaaaaaaaaaaaaaaaaaaaaaaaaaaaaaaaaaaaaaaaaaaaaaaaaaaaaaaaaaaaaaacagaacaaaacagaaaaaacaaaagggaaaaaaaagaaaaaaaaaaacaacaagaacaaaaaaaagaaaaaaaaaagaaagtcaacagcaaaaagaagcacacagacatacaaaaaatctagaacgaacacgcggcagagcacataaagcacagggaaacagacaacaagagaccacagaaaaagacagaaaagaccaccaaaacagggaagaagaaaaaacagaaacaaaaaaaat

SEQ ID NO: 426469 - DNA, 3734 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgcta

SEQ ID NO: 426470 - DNA, 3850 bp, Homo sapiens
gggaagatgtacgagtgcgatcagccggtgttatttgcgtcacgagggagcggtttgataaatgttatgtcagtgggtcgatagctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426471 - DNA, 5347 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttaatatttggtgacaaaagaacttaaattgaccgaaaatcaaaagttagtcgacc

SEQ ID NO: 426472 - DNA, 5545 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacagatacttgctaatcccacatggcagccgtttctgcccctcgagactcccctggtgaaggctggggaagctcagctgtgcaaacgccagtgatggcagctgccttcccgcagggtgttgtgtctgcacccctcacggcctccagcctcagggctcgggatcccacaggtggagcccagcactgacagcctgggtttcttaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426473 - DNA, 3595 bp, Homo sapiens
ggcagtggatctagaacactcctgctctttcataaccaaccagcctgaactggaatcagcctgagtgcaggttccagcagctcagcactgccccttggaggctgtcgtgaggcgcagagctcttggtgtggagaggttgccttctgtgaaacatgaccgtttaaggatcttaaaagtttgtaatcaccacagcctggaccatgtatcttgtctgggagggacagcttgttttttatagtgtcagggagggtgagaaacaggagagcttctgtgttctgtcccacctgccctccggggtctggtggcgtttacagtgcaggtgccctgatgcctctgcacccttccccagaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426474 - DNA, 3526 bp, Homo sapiens
ggcagtggatctagaacactcctgctctttcataaccaaccagcctgaactggaatcagcctgagtgcaggttccagcagctcagcactgccccttggaggctgtcgtgaggcgcagagctcttggtgtggagaggttgccttctgtgaaacatgaccgtttaaggatcttaaaagtttgtaatcaccacagcctggaccatgtatcttgtctgggagggacagcttgttttttatagtgtcagggagggtgagaaacaggagagcttctgtgttctgtcccacctgccctccggggtctggtggcgtttacagtgcaggtgccctgatgcctctgcacccttccccagaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426475 - DNA, 5177 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgcccgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426476 - DNA, 5012 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426477 - DNA, 4941 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttgttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426478 - DNA, 2880 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426479 - DNA, 2258 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggtagggctgacacggcccttgcgggcaagacccgggagggctttagggtggccagatggaaggcctggtgctgggagccttgggctctgtcacaccgaagagagcacgtggcgggtagtgtcgccatggtgcctaccgctctctatgtgacattattcgtgtcagctccaaccttaggattgcattttagtaaccaggtctgctactggtttagaaaactgggggcagggggggcatggctgcagcagcgtgagttccgtgtgcggcactttatagtgtggcgggatggtgcaagttccagccttggcattgcttgcggtgggtagagctgtgaagcctgggctgtctggatctgagctccttcggcatcgtgtcattactgcctgttaaaaatgtcaggagtttaaggccagcctgaacagggtgagacgtctctac

SEQ ID NO: 426480 - DNA, 485 bp, Homo sapiens
ccaggatgtggctgctccctgctggtgagcgctgctggcttcgctgccgccctctgcgtctctgaaaggggcctagatgggtggctgggagtggcaaggaggaactccaggctggctgggggtgggacaccggctcatggtgaggtagagtctttcttcaaggatgctgtccttctggtctctggtctggtgttggctgcacgtttttagcgtttggtgcagagccagcggtgtcttaagtaactaaattttaaaaacgctgtttaaagagcgtgtaccaagggtggcccagaaaggtcagcccggcttttgacaaggatgcaaacttaactcagcacacagattatggcgatgagatcgccattgagctgcggagcagcgtgggtgcacctgtggaggtgactcacaacttccaggtggattttgtgtggaagtcgacctcctttgacaggtacgtcttctcccatcactgccccctgttccct

SEQ ID NO: 426481 - DNA, 5379 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctggtaatgaggatttagtcataatttggttaagagacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426482 - DNA, 2643 bp, Homo sapiens
cgcggcgtgcacctgatgcctgttggtctgtctctagagtatccccaccgctataagcgtcatggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426483 - DNA, 5080 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttca

SEQ ID NO: 426484 - DNA, 3210 bp, Homo sapiens
gcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgggcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccaggccaggctctttccccagtcaggctccagacgcattgacaacaacagaaacagcatgacacgtaggaattcgacggcc

SEQ ID NO: 426485 - DNA, 556 bp, Homo sapiens
gatggcagctgccttcccgcagggtgttgtgtctgcacccctcacggcctccagcctcagggctcgggatcccacaggtggagcccagcactgacagcctgggtttcttaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggtgcgctgcgccctcgggcacacttggtctcctgggccatgcaagggtattgacccttgacctttaagttaccccccaagaggggcccgtcctggctggagctcagaatggcccaggaagcaccagctggcccaccctctggggagggcacagacagcacatccccacagaccctgcgaaattccacatgatcaggacagagactttgagaaatacatcacagggatcagaaacatgggctgagattggcacatcaaggtgttttctcgggatggttgaaacaagtcc

SEQ ID NO: 426486 - DNA, 211 bp, Homo sapiens
tcacggcgcctgctctcacggcagaggcttgctgtagggcccgcctcatggggcctcgggcatgtggaggccaggcccgggcctgtgctggaggctaaccggggctcttgtttttcatgtgctcagactcaagataacatcactgtcaggtgggacctgggccttaacaagaagagaatcgcctacttcactttgcccaagactgactctg

SEQ ID NO: 426487 - DNA, 489 bp, Homo sapiens
ccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccggtgagcgcctgcacaggacagcagggcagcacggagaaacccgggcccaaaacactgctgggaacgtgccagcttggcccgtgtgcccgtgagctgagggagggctctcctaggggagggtgggctctcctaggggagggtgggccagcccacttcttgtctcccgagccgtgtgtggcatttttggcttggggccgctaagtcctgggtggcctctgggaattgggctcagggctgctgtgctgcatgcagcagcctgggaccttggacacgggcagttggaagctttgcaagcccggggtgatctggtagtgagggggtgtgaagcttcctgagctg

SEQ ID NO: 426488 - DNA, 3649 bp, Homo sapiens
  misc_feature (2201)..(2201): n is a, c, g, or t
agcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgcatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccatcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtccccnaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactccatctcaaaaaaaaaaaaaagaaaaaaaaaaatgtctgcctatcctgagactgccctgctgtgaggaagcccaagcagtcacgtggacagtgcctgaccagccccagctttcaagccatccaagcccagtcaccaaacatgagagagaagaagccttcaggtgattctggactccactaacatatgactgataccgcatgatacatcccaagtgagaactgccccataaatccagaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccaatgcattccgatcctcatcacaattctttgact

SEQ ID NO: 426489 - DNA, 3703 bp, Homo sapiens
  misc_feature (2201)..(2201): n is a, c, g, or t
agcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgcatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccatcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtccccnaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactccatctcaaaaaaaaaaaaaagaaaaaaaaaaatgtctgcctatcctgagactgccctgctgtgaggaagcccaagcagtcacgtggacagtgcctgaccagccccagctttcaagccatccaagcccagtcaccaaacatgagagagaagaagccttcaggtgattctggactccactaacatatgactgataccgcatgatacatcccaagtgagaactgccccataaatccagaaaaccacattgctatcttaagtccctaagtttggggcttatttgttccacagcaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccaatgcattccgatcctcatcacaattctttgact

SEQ ID NO: 426490 - DNA, 2734 bp, Homo sapiens
agcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgcatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccatcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgcattgagctgagatcgtgccactgcactccaggctgggtgacagagcgagactccatctcaaaaaaaaaaaaaagaaaaaaaaaaatgtctgcctatcctgagactgccctgctgtgaggaagcccaagcagtcacgtggacagtgcctgaccagccccagctttcaagccatccaagcccagtcaccaaacatgagagagaagaagccttcaggtgattctggactccactaacatatgactgataccgcatgatacatcccaagtgagaactgccccataaatccagaaaaccacattgctatcttaagtccctaagtttggggcttatttgttccacagcaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccaatgcattccgatcctcatcacaattctttgact

SEQ ID NO: 426491 - DNA, 3552 bp, Homo sapiens
  misc_feature (2104)..(2104): n is a, c, g, or t
agcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccatcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtccccnaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactccatctcaaaaaaaaaaaaaagaaaaaaaaaaatgtctgcctatcctgagactgccctgctgtgaggaagcccaagcagtcacgtggacagtgcctgaccagccccagctttcaagccatccaagcccagtcaccaaacatgagagagaagaagccttcaggtgattctggactccactaacatatgactgataccgcatgatacatcccaagtgagaactgccccataaatccagaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccaatgcattccgatcctcatcacaattctttgact

SEQ ID NO: 426492 - DNA, 3733 bp, Homo sapiens
  misc_feature (2285)..(2285): n is a, c, g, or t
agcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgcatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccatcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggtaagagattctcttttccatgctttaggaaaatggtttggagaaggaagtgactaacgcagcgcttgtctgcattctccccaggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtccccnaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactccatctcaaaaaaaaaaaaaagaaaaaaaaaaatgtctgcctatcctgagactgccctgctgtgaggaagcccaagcagtcacgtggacagtgcctgaccagccccagctttcaagccatccaagcccagtcaccaaacatgagagagaagaagccttcaggtgattctggactccactaacatatgactgataccgcatgatacatcccaagtgagaactgccccataaatccagaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccaatgcattccgatcctcatcacaattctttgact

SEQ ID NO: 426493 - DNA, 762 bp, Homo sapiens
agcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctagtgcctgaccagccccagctttcaagccatccaagcccagtcaccaaacatgagagagaagaagccttcaggtgattctggactccactaacatatgactgataccgcatgatacatcccaagtgagaactgccccataaatccagaaaaccacattgctatcttaagtccctaagtttggggcttatttgttccacagcaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccaatgcattccgatcctcatcacaattctttgact

SEQ ID NO: 426494 - DNA, 494 bp, Homo sapiens
ggcgagactttatgacttgagaagctgtcctatctatgagggtccatgttagggaatattaaagaataggattgggggcagtagctttcctgtagcaagtgctagctatgtgccagatactgggcaaaggagtctgcagacgtctctcatttcatcctcacaatccatgaggcaggtatgactattcttcccattatccagagagggaaaacaagtcacacggaagcaagtcacgcagcagagctaggattggaacagaagtgcctgcatcctccaacgcctgcatcccaacccgctgtgctatgcctcccgttgatgctttcccatgtctgccatttagctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactac

SEQ ID NO: 426495 - DNA, 517 bp, Homo sapiens
gactggggctggagaacacttttccaagctctcacacagttgctcgtgggagagctcagttcctcaccacgtgaacctcgccctagaccacttgagtatccttggtatatggtggctggcttctcccagagcaagtgacccaagagagacagagcaagcaaccaagagtataaccaagatggaagccacagtctttggggggagaccccaacacttctgccatatgccattggtcacacagatcaaccctggtccagtgtgagaggccactgcccaggggtcccaggaggcagtgatcatttggggctttcatggaacctctccaccacactggctcactcctgggaaagagacagatctgttttcaatcgagatgtttgtttgtttgtttgcttttaattatgcacaggagaaacatcctgccaggtttaaacatcacttgtaccttccacaagactcagaatccacagtgtcccattttccgactaggagacatcttccgagaaacaggcgataa

SEQ ID NO: 426496 - DNA, 1510 bp, Homo sapiens
tggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaactcatcatcttgtttggtttt

SEQ ID NO: 426497 - DNA, 546 bp, Homo sapiens
agtttttattttgcttaaaacatattttgcctaaaaatcattcttgaaattgtatttcttcacagatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaaggtaggggagacttagaaaatgagacacataagtacctgctgccagtgtcctgcccactggcaactaggtcagctgagatgggtgtgatctgtagtcacctctggctgcattgctggcacagtgctgaacctgacctaggtgggacctggatgcatgtcattgaatcaagaagctaagaccatgtgttgtggtagatggaaacgagaattgagaatgtaaggagtgactttcaagttaattaggtggtacttaacaaatgatattgggaggagtttgactcctttgaaacctcttgtccagt

SEQ ID NO: 426498 - DNA, 4325 bp, Homo sapiens
cacttttatacttcccttcgtttgcatgtgttacttcttcagcctaggtctttccccttccgttcgttcttcaaaacccaggcaaaacacctcttcctctgagcagccttctcagaacttttctcccatgtggccagaggaaggagagacttctgtctatctcttctgctagaccccgaactctttggaggcagaggttatccacaagaggcttggcaaatgtttctcagtcatagttggactgtttgaaaaattaaaggttctatttgtccgtcagtttcatccgtgacatttaactttttataccaaagtcttagaatctaccatcattttttgggccattgataccactttaaccacagttaatttcagcttttggcaggaaagagaggaaacatcctgtgatgtttcagcactgcatttttttccccatctcattcaggagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaaaaaaagcaacaaaaaaaaaaaacaacgaacacacaaaaccgaaaaacacaaacaaaaaaaacgaaaaaaggcacaccaaaggaaggggggggcccaaaaaacccccagcgggagccacacaacaagagacacccaccgatgttgtgaaaaaaggagacccacataaagagagagatcaaaaaaaaaagaagcagacgggcgccacagaaaaagacaggccgcgacgaaggaacaaaaagacgcgccacaccagagaaacttgggaagaggaacacaccactcgggggggggggcaacaacaggcgacacaacacccccgcagagaagaatgaggagcgcccgaggatataacaccacgatagggagatgaagggacgaacacacgactgtaagagccgcgcacgaaagaatagcgcgagggaatacgggaggcaatga

SEQ ID NO: 426499 - DNA, 1370 bp, Homo sapiens
gcctgggaaacatgccgagaccccgtctctactaaaaatacaaaaagtagctaggtgtggtggtgtacacctgtagtcccagctattcgggaggctgaggggggaggattgcttgagcctgggaggttgagactgcagtgagccaagattgtgccaccgccctccagcctgggtgacagagcaagaccctgtctttaaaaaaacaaaacaaaacaaaaatgtatattgccaagccaccagattcttcacttataaaattccagcattagcatttataatccagatcacttatgacttatttcagtaaatggcccttttctcatttgtggcttatttactctagttgccagttgggtgccactgaggtgcttcatgtaaattctcacttagtttttacatttctgagcagaaggtatttatctccatgtataaatgaggtaatggaggatcagatgttagccaacttgccctgtcatactggtaatactggaaatcagattggtaactagctttgtctgactccaaagagattgtcttctatagagtaattcaccttcaaggaactttatgcacatggcttttctaaatgaaagttgttccagttaaaatgccaataaaataatttattcagtagcttatagagtcttgagtatctgaaaaatcacaagtttttacagttctagtaatcatagtagttgatatttatagatctttaaatacatggcacatcatacagctcaattccaagtaagtctgaaattttatacaatgatatttgacaccaactcactgtttagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggtaagggtttatcctgctattctctgggttcgtaggattgaccacctcccccagctaagctaaaacacagatgtgggggtgctggggtaggggagggaaaggctggttggcttccatttgtagcagcagatgattcatgatatctctattttccctctgagaaaggatgaacactggcgtggagaagcactccgggagaaactgcgtcaccgggaagaccgactcaaggttgccctttaaaacaaacaaaaaatcagtatgagatactgggcacattggggaggggaggggaaagttacatttacc

SEQ ID NO: 426500 - DNA, 814 bp, Homo sapiens
aaagttcttggaaaactgtaacctgagggatgatcatgattatcatattgttgttcttactgtgatcactgtgatttgagtggttttaagtatgtgagctcaaggttttcattaggcatttcacccttgcactccttgcctggcttttctgactcttgggggctaggatattagctcctgattttacctcacaactaaattatctccaggttagcactgagggctgtatggcctttgtcaaacttactcttcccttttctttaatacaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgcttttctacagtaagcaagtatctctatgatcagaaaaaaagttaatatttaaatatctgtatttcaaaggccaaaaaattgttatataaatctcagtctgtatttcaaagtatttttaatttattttgatcaattttatataaaatgcttttagttgattcttttatgtagaagcaaatgctttggaaccagatctttgttaattaaatgtttttgtta

SEQ ID NO: 426501 - DNA, 970 bp, Homo sapiens
agcactcacagtctatcaattgaggtataaactggaacaatctcccagtgtttcaaggctcttaaaattcacacctgttgaactagtcagcccatttctactcctccagaaagggcaagtatgtacatcgcagcaatatttataatgacaaaatttggaaacaggctgggtgtggtggttcatgcctataatcccagctctttgggaggctgaggcaagaggattgcttgagcccaggagttcaaaactacctgggcaatgtatgagaccccatctctacaaaaatattcaaaaattagcgatgcacattgatgtgcacctatagtcccagctattcagaaggccaagcagggaggatcccttgagctcaggagatcaaggctgcagtgagctatgattatgccactatgcttcagcctgggaaacagaggaagaccctgttccaccacaccccccaaaaaattggaaacagatgaccaatttaaaagccatatttttaacctttaatgacatgcaaacatgaccatgagaagaatgaaaaaaagtaggtaaaaaatgaatatggagtatagtcccagtttattttaaaatgtgtgagagtgtgtgtgtgtgtgcgcgcgtgctcacgcgcacacacatgcattcttagaaggaaatacatcaaaatgctattgtaaaagtgatttggggtggtgaaataatggtgggttttcatttttttctcttatgctttttttttgtattttccagcttttctacagtaagcaagtatctctatgatcagaaaaaaagttaatatttaaatatctgtatttcaaaggccaaaaaattgttatataaatctcagtctgtatttcaaagtatttttaatttattttgatcaattttatataaaatgcttttagttgattcttttatgtagaagcaaatgctttggaaccagatctttgttaattaaatgtttttgtta

SEQ ID NO: 426502 - DNA, 393 bp, Homo sapiens
atttcttatttcatgagaatgtcatttctttagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagcaaagaccccaaaagagcaaagaccccaaaagagcaaagaccccaaaagagcaaagacccaaaag

SEQ ID NO: 426503 - DNA, 5903 bp, Homo sapiens
  misc_feature (2)..(3): n is a, c, g, or t
gnnacgaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426504 - DNA, 5491 bp, Homo sapiens
  misc_feature (2)..(3): n is a, c, g, or t
gnnacgaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggtaagggtttatcctgctattctctgggttcgtaggattgaccacctcccccagctaagctaaaacacagatgtgggggtgctggggtaggggagggaaaggctggttggcttccatttgtagcagcagatgattcatgatatctctattttccctctgagaaaggatgaacactggcgtggagaagcactccgggagaaactgcgtcaccgggaagaccgactcaaggttgccctttaaaacaaacaaaaaatcagtatgagatactgggcacattggggaggggaggggaaagttacatttacc

SEQ ID NO: 426505 - DNA, 4458 bp, Homo sapiens
  misc_feature (2)..(3): n is a, c, g, or t
gnnacgaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataaggcagcaaaacagtgaaagtgtgtgatttccttgcccttcgttagattctttgatttttcttacgacaagtaattcctgctaatgagcatggtgtttctttctaaaattagattgtggtaatgtttgcacaacttggaatatactaaaagcctttgaattgtacactttaaataggacatgatatgtgaattttatctcaataaagtcagttaaaaaaaaaaacctaattcatgttccttagagaacaattttaaaacagcaaaaagaaataaaaattgctgttgacctcactcctcatagattcctagtaacagtttggtgaatatccttccagatttttcctaggggtgtgtctagtttgaaaaacaaaaacaaa

SEQ ID NO: 426506 - DNA, 3804 bp, Homo sapiens
  misc_feature (2)..(3): n is a, c, g, or t
gnnacgaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgcttttctacagtaagcaagtatctctatgatcagaaaaaaagttaatatttaaatatctgtatttcaaaggccaaaaaattgttatataaatctcagtctgtatttcaaagtatttttaatttattttgatcaattttatataaaatgcttttagttgattcttttatgtagaagcaaatgctttggaaccagatctttgttaattaaatgtttttgtta

SEQ ID NO: 426507 - DNA, 6005 bp, Homo sapiens
  misc_feature (2)..(3): n is a, c, g, or t
gnnacgaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagtaagtaaggcctctgtagggctacaaggggtttgtgctggaagacagctctggggttccgagtcccttaggatctgctctagtgttgctggtgctttgtaggcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426508 - DNA, 5774 bp, Homo sapiens
  misc_feature (2)..(3): n is a, c, g, or t
gnnacgaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426509 - DNA, 5695 bp, Homo sapiens
  misc_feature (2)..(3): n is a, c, g, or t
gnnacgaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426510 - DNA, 4782 bp, Homo sapiens
agtttttattttgcttaaaacatattttgcctaaaaatcattcttgaaattgtatttcttcacagatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426511 - DNA, 3025 bp, Homo sapiens
gtatacattgagatgaatgaaaagtttgcttctaaggggataataattggtttatgataaataatgcatggtaagtctacaggacctggggggaataaagcaatgtgctttagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426512 - DNA, 2913 bp, Homo sapiens
aaagttcttggaaaactgtaacctgagggatgatcatgattatcatattgttgttcttactgtgatcactgtgatttgagtggttttaagtatgtgagctcaaggttttcattaggcatttcacccttgcactccttgcctggcttttctgactcttgggggctaggatattagctcctgattttacctcacaactaaattatctccaggttagcactgagggctgtatggcctttgtcaaacttactcttcccttttctttaatacaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426513 - DNA, 3127 bp, Homo sapiens
gtatacattgagatgaatgaaaagtttgcttctaaggggataataattggtttatgataaataatgcatggtaagtctacaggacctggggggaataaagcaatgtgctttagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagtaagtaaggcctctgtagggctacaaggggtttgtgctggaagacagctctggggttccgagtcccttaggatctgctctagtgttgctggtgctttgtaggcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426514 - DNA, 2807 bp, Homo sapiens
atgggatactgacatgaccagaaaggcgaactggaccaagtgctctcaaaggtgctgacagctgaagagcgtgttaggactctgcaggaagaggagaggtggtgtgagagcctggagaagacactctcccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426515 - DNA, 2828 bp, Homo sapiens
  misc_feature (2)..(3): n is a, c, g, or t
gnnacgaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426516 - DNA, 2486 bp, Homo sapiens
caatagcattgttttctgtttcattttgtaaatgttttccaagttcatttaatatcatggaccatgctttgtttctatcccttagaactaaagaatattctggacatgttgcaacttgaaaaccatgagctacaaggtttgaagctacaacatgaccaaagggtatctgaattagagaagactcaggtggcagtgctagaggtaatgaacaaagccagtgtacccttaagaaactgaagtctttctcatttaagatgtttgagtcctcttttatctgatttaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaggtataagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426517 - DNA, 1947 bp, Homo sapiens
gcctgggaaacatgccgagaccccgtctctactaaaaatacaaaaagtagctaggtgtggtggtgtacacctgtagtcccagctattcgggaggctgaggggggaggattgcttgagcctgggaggttgagactgcagtgagccaagattgtgccaccgccctccagcctgggtgacagagcaagaccctgtctttaaaaaaacaaaacaaaacaaaaatgtatattgccaagccaccagattcttcacttataaaattccagcattagcatttataatccagatcacttatgacttatttcagtaaatggcccttttctcatttgtggcttatttactctagttgccagttgggtgccactgaggtgcttcatgtaaattctcacttagtttttacatttctgagcagaaggtatttatctccatgtataaatgaggtaatggaggatcagatgttagccaacttgccctgtcatactggtaatactggaaatcagattggtaactagctttgtctgactccaaagagattgtcttctatagagtaattcaccttcaaggaactttatgcacatggcttttctaaatgaaagttgttccagttaaaatgccaataaaataatttattcagtagcttatagagtcttgagtatctgaaaaatcacaagtttttacagttctagtaatcatagtagttgatatttatagatctttaaatacatggcacatcatacagctcaattccaagtaagtctgaaattttatacaatgatatttgacaccaactcactgtttagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggtaagggtttatcctgctattctctgggttcgtaggattgaccacctcccccagctaagctaaaacacagatgtgggggtgctggggtaggggagggaaaggctggttggcttccatttgtagcagcagatgattcatgatatctctattttccctctgagaaaggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426518 - DNA, 925 bp, Homo sapiens
gaagcaagggatacagaaatcctaagcactgctagcatggaaaaactgggccaagtgaaagaccccgttaatgacaacacagaaaagtaaaggtttatgcacactaagtatccacctggcacctcctacaattctttttaaagatgagcatttttgacagccattcctactgttagccagatttgcctatcaaatgtatgtgaggaagctgagcggcagttctggtacatttcttctgtgtaaaaccctaagtcttatcacacttttcaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426519 - DNA, 2722 bp, Homo sapiens
  misc_feature (2)..(3): n is a, c, g, or t
gnnacgaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagtaagtggaaagacatacaactctctttccacactgcttccatgggtgactgataaggttatatacttaatgagttgacctatttatgactggattatatggcaaagtgtgtttgtaaggctgatgtttagaactgtgcaagcattctcttattaaaattctcttataaaagcagtggcatgtgcctataatccgagctactcaggagactgagacaagaggattgcttgagcctaggaattcaaggccagccccggtaacagc

SEQ ID NO: 426520 - DNA, 2072 bp, Homo sapiens
  misc_feature (2)..(3): n is a, c, g, or t
gnnacgaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggtgagttcacatgtacagaacaggtttccatcaatgatgctgctgtcaaaaaacatggcaacttgtattattgatcttgctatagacattggttattttataaaccactgtaaagttgtctgtttttcttaagacctaaagattatattccccccatcacaacccccaataatttattttgtgctgccatggatactgcgttctactgagccctgaaaggaatcatcaaataaacatgctatccctacctttaagtgtaaggatgcttagggaggtagctgtcaatatctacctggacaagggttcctgaaggattgttatataatccctctgaatctcaaatttttcatctcgtgcagtcatgtgaaaatgttacttcatagtatgactccttactgagctaatgtctgttactgtgctttataggatgcaaatgctaatgagattaagatagcagatcataggagacaaaaatctaatgatgagagcccagagagacataatcatggaagacggtagtaaaagt

SEQ ID NO: 426521 - DNA, 1667 bp, Homo sapiens
  misc_feature (2)..(3): n is a, c, g, or t
gnnacgaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaaggtaggggagacttagaaaatgagacacataagtacctgctgccagtgtcctgcccactggcaactaggtcagctgagatgggtgtgatctgtagtcacctctggctgcattgctggcacagtgctgaacctgacctaggtgggacctggatgcatgtcattgaatcaagaagctaagaccatgtgttgtggtagatggaaacgagaattgagaatgtaaggagtgactttcaagttaattaggtggtacttaacaaatgatattgggaggagtttgactcctttgaaacctcttgtccagt

SEQ ID NO: 426522 - DNA, 436 bp, Homo sapiens
tcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggtaagactttcagtatgatttaaggtaaatcagtgttattgctggtaaaagaaacattataaagacaagcattaatccagatagtagctaaatacagttcacctattagtactagtatttgatagggaaatatttacaggatacccaaaagtagttaatgcaattttaagagttttgtttttgttttgttttgtggcattgatgcctagtgagtcaggtcattccagtcagtaggccagaagtcaatacgtgatcatgataagctctggcatgtgattgtctatgacataaaatcc

SEQ ID NO: 426523 - DNA, 738 bp, Homo sapiens
tatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaacttgggtctgtcctctgactttacacttcacaggtcattctatggaaaagccgtcaaatttttaccttattccaagtaagtaatctttcaggtggttttcttttacctggaggctgaagtacattatacttatcaatgaagatttcatcatttggaaatacatcaattataaaactattatgcttcagatgcctttccttagccaacatattctttggtggaaaatcaggaaaactttgtaccttggagaatgtgacccagtgataaattcaaattgtgttgcctttcagattttgaactaccataattaacagctcaactccatgatgtatacatttctttaaaaactagaatagcaactgctctcacagtctggcataattattcccaagggggaaatatgtaataagaagttttaaaatattctcgggaactcttttctagatcactactagacagcttttgagtcacaacaggtatgttaccctgttactaataat

SEQ ID NO: 426524 - DNA, 723 bp, Homo sapiens
tactgacactgatgccatccctgctcacaggatagatgttacagatttttttttaaactagaacttttaattggaggatcttgaattttagcagttttaagaataaccgtttaattttttctctcagaattttgtacactggttcatcttaaaacatttttccaaagaggtactcaaatatgtcatttacctataagccatcatgccatcacttagttaagactgtttttactgtttcaagaatttgatttatccttccttttgtcttactgtaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 426525 - DNA, 453 bp, Homo sapiens
gagtgagactctgtctcaaaaaaagaaaaaaagagttttgtatttgtaatttcaaaataaataatgtttacaaatcagtttgcctttttttgacttaccaaagggcagactgaaagtcagctttgaggaactgataaaattaattggctctcttagaatctcttttatattttgagaaaggaagtaagtgatttcatatcaatttcatagaatgacttttctttacagacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtaggaattctgtggtgttgggaatgtatactgaattttcttgaagaaagtgtgacattgtccccttccccaaatt

SEQ ID NO: 426526 - DNA, 383 bp, Homo sapiens
tagaggtaatgaacaaagccagtgtacccttaagaaactgaagtctttctcatttaagatgtttgagtcctcttttatctgatttaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaaggtgagagcaagaacaaataagcttgcaggatcacttcttcaggccaaagcattataaacacactataaaaaatttgga

SEQ ID NO: 426527 - DNA, 1926 bp, Homo sapiens
aaaaaaagctcaccaaatcaaaagagaggaagtgctaagcaaatacaggaaccaaaaaggtttatagaggctgccttatgctgtctcatccagttcctttgcggtcctcttcttcagcacatgccaaagctgttcctcacggcctgtgagacaagagcatcttggatgtaggacaatggaagagttagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcagctcgtgtatactaccaatatccaggagctcaatgtctacagtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctcgagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataaaaaaatg

SEQ ID NO: 426528 - DNA, 1352 bp, Homo sapiens
tatctgggcgttggcgtacctttctcggggtgtctgcgtaactgcccagacttgccttggtttggtcagatgacacctcctctgggactggctagccagcgttcatgtctacattattgatctcgtcttccggtgtgtgagtcactcacctgtgagctcctagaggtcagcgactaaatctggttccatggggtccttgggccctcggagccctagcacaaggcccactactcagttggctcttaatcaaatctgtgaaacgaattataaagttgcttttctactagaccttgttgggacaccaaggagccggcgtcggttgcttaacttggatgcggtgcctgacctagagggaggcgaaagggttgtgagcgtgacatgactggtgacctacaccgagaagctgaagggtctcttaagctctgcggccggaagccatctgcttctgcggtttatacaatagcaactttatcagaggttacttttctgcacgctagcgtatgacattaatttgtcttcctgattcatcaaagggaatttccgttgcagttggtgatgcagtgggcctctcccatttcttttttcttttcatccattacaatcaaggaacgatttgcaagaacatcctttacccctggaaaataaggcatccagggctaaaagtcccaaaagaaagaagctggaaacaagatctggggatccaattttaaatttcacattaatcattcagttaaactgtagacaagtgctgaagtacatttttccttccagtactttgactcagataccacttcatattagacaaatgttttatattctctactgagtattttccattttcatagggctaatgtcattttcagttgtaataatcgattggcatagtgtcaatggaaattttttaagattgagtttgtagtgagcagacttttggaaggaacagtgctgacatccaatggatgctcaaagtaatacagaggaggaatctcctttcaaaaaaaaatgtacagacagtggaatggagaatgaattattccctaaaaaaaaaaagccactgtgggctggatgtggtagctcacccccggaatcccagcgcttttggatgccaaagtgggaggatcccttgagcccagaacttccagaccagcctgggcaacatagggagaccaccctctacataaaaaataaaaataaagcttttaagctaacctggtggcgtgatgggatgcacctctggtcccagctactccagaagctgagaagggcaaatcgcttgagttcaggagttcgagttggaggttacactgaactatgatagtacctttgcacgccagcctgggtgacagagagct

SEQ ID NO: 426529 - DNA, 1870 bp, Homo sapiens
tatctgggcgttggcgtacctttctcggggtgtctgcgtaactgcccagacttgccttggtttggtcagatgacacctcctctgggactggctagccagcgttcatgtctacattattgatctcgtcttccgatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcagctcgtgtatactaccaatatccaggagctcaatgtctacagtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctcgagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataaaaaaatg

SEQ ID NO: 426530 - DNA, 1649 bp, Homo sapiens
aatacatctatttttaattcaaatatatggtatgagtcattgtgtttagatcttgcatccatctggaaattattatttagtagtattttattttaaaatatcagatgctttttttcttcccagatgctgttttagatattagagatataatggtgacaagatcaacaatatctagtttctctcagagctaatgttcctgtaaggggagacagcccacaaagatgattttaaataaaggtaaatgccataaagacggtgaaagaagatgatgtgacaaggagggactgaagagatgcctctctgataagatgatatttgagtgattcttgcatcacatgaagaggacaactatatcaggctctgggacagaactatccaagccaagggaatacttagtacaaaggcactgaggagcaatagcccctaacacttattaaatgtttactatgaaccagacacaatgccaaaacacttcctctgcattatctcatttatttcttacaactaccctttgaattaggtaacagtaatcatcctattttgaatatgaggacacagattgaaagggcctcctctcagtctccagtgtagctttcagggctcaacctgcaacagtgaattcctgattttatctctccaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataaaaaaatg

SEQ ID NO: 426531 - DNA, 1051 bp, Homo sapiens
aaacgagatacagatccatttgcttgtctgttttgcaagcgggaaatctagtctccatttgtcaagaacctgagggaaattcctgtagctggcaggtaactgtcaggaatttcaaggctgaaaattttactttgctgacattttacctcttgacatttgcattctttttctctctcttctctctaccccaggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataaaaaaatg

SEQ ID NO: 426532 - DNA, 379 bp, Homo sapiens
tagaggctgccttatgctgtctcatccagttcctttgcggtcctcttcttcagcacatgccaaagctgttcctcacggcctgtgagacaagagcatcttggatgtaggacaatggaagagttaggtgagtgaggagcctgaggagaaactctgagggagtgaagacttggctgccatctccttgtgtggtggggtatacttctggctagactgagggtagtaatggaagattttattttcacttctttcctgtcctcagccctgccaagagtgaagcatgaggaactatgattgttttggggaactatgggttcactgtttgcagtggcaaaatagatggagagtttggtgctaaccgcggaataaactcttggcaaat

SEQ ID NO: 426533 - DNA, 1879 bp, Homo sapiens
aaaaaaagctcaccaaatcaaaagagaggaagtgctaagcaaatacaggaaccaaaaaggtttatagaggctgccttatgctgtctcatccagttcctttgcggtcctcttcttcagcacatgccaaagctgttcctcacggcctgtgagacaagagcatcttggatgtaggacaatggaagagttagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccgtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctcgagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataaaaaaatg

SEQ ID NO: 426534 - DNA, 2214 bp, Homo sapiens
aaaaaaagctcaccaaatcaaaagagaggaagtgctaagcaaatacaggaaccaaaaaggtttatagaggctgccttatgctgtctcatccagttcctttgcggtcctcttcttcagcacatgccaaagctgttcctcacggcctgtgagacaagagcatcttggatgtaggacaatggaagagttagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcagctcgtgtatactaccaatatccaggagctcaatgtctacagtgaagcccaagagccaaaggaatcaccaccaccttctaaaacgtcagcagctgctcagttggatgagctcatggctcacctgactgagatgcaggccaagtagagacggagtttcaccatcttggccaggctggtctcgaactcctgacttcgtgatccacctgcctcggcctcccaaagtgctgggattacaggcgtgagccactgcgcccggccaaaaggactgttaaagagacctgactaagcaggacagaggagaccagtgagcaagctgagacacagcaagggagatcaaagtatggctctgacagtaggaaggatgagaagtcccaagcccatattgagataaaatctgcctctttgttctagcctctagaacacctctaaagttgcagtgagagcagatgctggcaagaagcacttaccagacaagcaggatcacaaggcctccctggactcaatgcttgggggtctcgagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataaaaaaatg

SEQ ID NO: 426535 - DNA, 3129 bp, Homo sapiens
ttctccgctccccaagccggagcccgagctggaggaagcccccaggtgccaggatctgcccggatccgcgcccgctccggccggcaccatggacagcgaggcattccagagcgcgcgggactttctggacatgaacttccagtcgctggccatgaaacacatggatctgaagcagatggagctggacacggcggcggccaaggtggatgaactgaccaagcagctggagtcgctgtggtcagactctcccgcgcctcctggcccgcaggccggacccccttctaggccgccccggtacagctccagctcgatccctgagcccttcggcagccgagggtcccccccggaaggcggccaccgacggcgcagacaccccgttcggacgatcagagagtgccccaaccctacacccctacagcccgctgtcccccaagggacggccgtcgtcgccgcgcaccccgctctacctgcagccggacgcctacggcagcctggaccgcgcgacctcgccccggccccgcgccttcgatggcgcaggcagctccctcggccgtgcgccctccccgcggacccgggccaggcccgctccgccagcagggtccccccacgcctttcgacttcctgggccgcgcaggctccccccgcggcagccccctggcggaggggccccaggccttcttccccgagcgtgggccgtcaccgcgcccccctgccacagcctacgacgcgccagcgtccgccttcgggagctccctgctaggctccggcggcagcgcattcgccccgcctctgcgcgcgcaagacgacctgacgctgcgccggcggcctccgaaagcctggaacgagtctgacctggacgtggcgtacgagaagaagccttcgcagacagcgagctatgaacgcctggacgtcttcgcaaggcctgcctcgccgagcctgcagctgttgccttggagggagagcagcctggatggactggggggcaccggcaaggacaacctcactagcgccaccctgccgcgcaattacaaggtctctcctctggccagcgaccggcgttcagacgcgggcagctaccggcgctcgctgggctccgcggggccgtcgggcactttgcctcgcagctggcagcccgtcagccgcatccccatgcccccctccagcccccagccccgcggggccccgcgccagcgtcccatccccctcagcatgatcttcaagctgcagaacgccttctgggagcacggggccagccgcgccatgctccctgggtcccccctcttcacccgagcacccccgcctaagctgcagccccaaccacaaccacagccccagccacaatcacaaccacagccccagctgcccccacagccccagacccaaccccaaacccctaccccagccccccagcatccccaacagacatggccccctgtgaacgaaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatggagatgcgctctgtgctgcggaaggcgggctccccgcgcaaggcccgccgcgcgcgcctcaaccctctggtgctcctcctggacgcggcgctgaccggggagctggaggtggtgcagcaggcggtgaaggagatgaacgacccgagccagcccaacgaggagggcatcactgccttgcacaacgccatctgcggcgccaactactctatcgtggatttcctcatcaccgcgggtgccaatgtcaactcccccgacagccacggctggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcgggctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaa

SEQ ID NO: 426536 - DNA, 2589 bp, Homo sapiens
gcggccgcgtcgacaaacaagtgagtctcggctggagtgcagtggtgcagtggtgcaatctcggctcactgcaacctccgcctcctgggttcaagcgattcctgtgcctcggccttccgagtagctgggattgcaggcgtgtgccaccacgcccggctaatttttttttttttttttttttttttgtatttttagtagagacagggttttaccatgttggccaggctggtctcaaactcctgatctcaagagatctgcctgcctcggcctcccaaagttctgggattacaggtgtgagccactcgactcagccaataatgcatatttttatttccacctgctttactgtcagaatgagtaagacagagaagaaatcattaaacaccaggattctacttcctgctggagttttctgcctgagatgttaggagaggaaactctcaggatctcagaaaatcacatctatcacggttggtagaagtagattctagagtcagccagaactgagttcaagtcccaactgcatggctttgggcaactgacttgtcctctctgaggcccagattccctttcggtaatgtggagatggcagtgtatctacctcacaaagcagtggtgagattacaataaggtaggcatgtaaagcgccaggcacatactaactgctcaataaatgggaggcatcataattgtatattattcacagcccaaggaaagtgtagcccagagagggcaaggaacttgaccctgaggtcaacacagaaaatcatgtgctggttgtatgccctggaagttgtggagagggagtgttgggtgtcttcctggggacctgtcctctgatgggctcttgttccggctaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatggagatgcgctctgtgctgcggaaggcgggctccccgcgcaaggcccgccgcgcgcgcctcaaccctctggtgctcctcctggacgcggcgctgaccggggagctggaggtggtgcagcaggcggtgaaggagatgaacgacccgagccagcccaacgaggagggcatcactgccttgcacaacgccatctgcggcgccaactactctatcgtggatttcctcatcaccgcgggtgccaatgtcaactcccccgacagccacggctggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcgggctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaaaaaaaaaaacacaaccttcggccgccccaccaagctctgtctcc

SEQ ID NO: 426537 - DNA, 342 bp, Homo sapiens
actgaaaaaaaatcactggtgtctgaaaaactggttcactttacaaaaaaagaatccaggcatcagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaa

SEQ ID NO: 426538 - DNA, 511 bp, Homo sapiens
gacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagggtttcgatgagtcatcaaacccttaaggtaggcatgtaaagcgccaggcacatactaactgctcaataaatgggaggcatcataattgtatattattcacagcccaaggaaagtgtagcccagagagggcaaggaacttgaccctgaggtcaacacagaaaatcatgtgctggttgtatgccctggaagttgtggagagggtttcgatgaggtcatcaaacccttcatcaaacccttcataaaaccctaaaccctatacaagtagaccactacagccagggtttcgagtgacggggatcc

SEQ ID NO: 426539 - DNA, 3161 bp, Homo sapiens
ttctccgctccccaagccggagcccgagctggaggaagcccccaggtgccaggatctgcccggatccgcgcccgctccggccggcaccatggacagcgaggcattccagagcgcgcgggactttctggacatgaacttccagtcgctggccatgaaacacatggatctgaagcagatggagctggacacggcggcggccaaggtggatgaactgaccaagcagctggagtcgctgtggtcagactctcccgcgcctcctggcccgcaggccggacccccttctaggccgccccggtacagctccagctcgatccctgagcccttcggcagccgagggtcccccccggaaggcggccaccgacggcgcagacaccccgttcggacgatcagagagtgccccaaccctacacccctacagcccgctgtcccccaagggacggccgtcgtcgccgcgcaccccgctctacctgcagccggacgcctacggcagcctggaccgcgcgacctcgccccggccccgcgccttcgatggcgcaggcagctccctcggccgtgcgccctccccgcggacccgggccaggcccgctccgccagcagggtccccccacgcctttcgacttcctgggccgcgcaggctccccccgcggcagccccctggcggaggggccccaggccttcttccccgagcgtgggccgtcaccgcgcccccctgccacagcctacgacgcgccagcgtccgccttcgggagctccctgctaggctccggcggcagcgcattcgccccgcctctgcgcgcgcaagacgacctgacgctgcgccggcggcctccgaaagcctggaacgagtctgacctggacgtggcgtacgagaagaagccttcgcagacagcgagctatgaacgcctggacgtcttcgcaaggcctgcctcgccgagcctgcagctgttgccttggagggagagcagcctggatggactggggggcaccggcaaggacaacctcactagcgccaccctgccgcgcaattacaaggtctctcctctggccagcgaccggcgttcagacgcgggcagctaccggcgctcgctgggctccgcggggccgtcgggcactttgcctcgcagctggcagcccgtcagccgcatccccatgcccccctccagcccccagccccgcggggccccgcgccagcgtcccatccccctcagcatgatcttcaagctgcagaacgccttctgggagcacggggccagccgcgccatgctccctgggtcccccctcttcacccgagcacccccgcctaagctgcagccccaaccacaaccacagccccagccacaatcacaaccacagccccagctgcccccacagccccagacccaaccccaaacccctaccccagccccccagcatccccaacagacatggccccctgtgaacgaaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatggagatgcgctctgtgctgcggaaggcgggctccccgcgcaaggcccgccgcgcgcgcctcaaccctctggtgctcctcctggacgcggcgctgaccggggagctggaggtggtgcagcaggcggtgaaggagatgaacgacccgagccagcccaacgaggagggcatcactgccttgcacaacgccatctgcggcgccaactactctatcgtggatttcctcatcaccgcgggtgccaatgtcaactcccccgacagccacggctggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcgggctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactggtttaatgtttataaacaaaatagagaaactttccttataaataaaagtagtttgcacagaaa

SEQ ID NO: 426540 - DNA, 1144 bp, Homo sapiens
tcgaaagaggaggtgacagcacatggacagacatggacagcacgaggagggtatgaacgacccgagccagcccaacgaggagggcatcactgccttgcacaacgccatctgcggcgccaactactctatcgtggatttcctcatcaccgcgggtgccaatgtcaactcccccgacagccacggctggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcgggctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaa

SEQ ID NO: 426541 - DNA, 1023 bp, Homo sapiens
tttttagtagagacagggtctcgtcatgttgaccaggcttgtcttgaactcctgagctcaggtcatccacccacctcggcctcccaaactgctgggattataggtgtgacccactgctcccggccctgagagaggagattttttaaatatggaggtgggacccaaaaagacaaccaaggtgttagagagaggtgggcttctccttatggcagttaggagacactggaaatattccatttcatcagtggaggctctgattggaaggttccatctggttcttggaggtgacacagaacttggattctggagcagtttgggaggtgctgagaggtccccttaggaaggggtgggaggatagagacaggcagcggatttgcatgtgggatgaggaggtgggagctcctgatgtctgaagatcctgtctctccccagctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaa

SEQ ID NO: 426542 - DNA, 223 bp, Homo sapiens
ttcccagctggggaggtgaaagggtaaagggcttccaggggaaggaactgagttgaggcgttgtcccgctcctgacggcgtctgactccctgagggcggggtctagaggggcggggtcttagccagctccctccctccccaccatgcaggcgcccgctccggccggcaccatggacagcgaggcattccagagcgcgcgggactttctggacatgaacttcca

SEQ ID NO: 426543 - DNA, 1268 bp, Homo sapiens
gtatgtttgtagccagtggggaattattttaactaggcaataatttgatctattttgggaagcctcttgtaatcaaatcatatatcaacattaatcacatggtgagtcctccatggttttcattcctagagattctaggatgtttgacatttctctgcttagcttatagcagaaaggtattggatatcaagaatgtttgaacagtttctcctttttgggaatgaagatgaaattgggctagaatgagatgtgtgattgagagaatgtccctgaggcctgagcagtgtgtccttttgggtatgggcattggaagcatgtagtgaattcttataattttatgttgcctcggcatccatcttgagtataagtttaactttgttataccagaagcaaggcttactcacttttgcacagtttccagttctacacctccttctcgttcctcagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctccctctctctccctctctctctctcgctccctgacctctgcgtgtggactccaggcatgccatatacccctcaggacctgtaagtaatactatctttatttttattttatatctctcctaatcattgaaaaggtgctctctatcttgaagatactatattaaataaaatgagaacttgtccctaacacagttagtgataggctgaaacacgctgattgcactctttacccatttagtgatttttctcaagttactctacaccatgtattatcaacataattgatattacagaatagaattataagacacttcttttgccacagaaagttctattggactcagattatctagagctactacatgtatgctattctatgataaaagatgtagatgtgataaaaacatttataaaatatctgtcttagaaaagttagctaaaattattttgggaaaagtatgtttgaaaatagaatcgtaagctaccacattgtgataaatatttctaaatgtgtctattaacttgtcaggagacaacagagtgaat

SEQ ID NO: 426544 - DNA, 798 bp, Homo sapiens
atcgatgatgactataaaaaaaatggatctcatcggaatctgaacaaaatgagtgaccaaatcatttctgtgccacttctgtgagctgaggtccagcactgggaccatgccaggcaaacatgaggagggagtttacagggactagggtattggaaaactaacctacccatatatattagagcaaatgaattgttctcagttctgtaaatatccagctgtggtttgacatagcaactctctttgtatttgcttggcagcatttatagaaacagctggtagaccctggggaaccagggcatagtgagattcatgggacgttatttcacctactcttgagccattcacacatttgagctcgcagaattatctggtcaatgagcagtctcttgagggtaatgagatggtcaacatccaaatccaaagataactaatgtctcagattttttttaaaaaagtttatattctatagtgatcaaagatgtaagaataatttttcttgtcattcattggatagtccagtgagtgtctactgtgaattcttatattcacttgtaactaaacattccatttggcaaatttcgtttcataacttccctaatttcctctacactttgtagattgggtgagatacaattccatggaattttaccactgaaccagtggagggctaattttgtcatttgtaccagttaactaacttgggaggaaacagaacaacacactcctgaggtagtatccaatttttagtaaatttatttttattatttttcaaactgtcagtgatttggtttggtgaac

SEQ ID NO: 426545 - DNA, 179 bp, Homo sapiens
  misc_feature (1)..(1): n is a, c, g, or t
ncgacgatagatcgagctcggtacctcatcttcaagaatccgtaggaattctcccatgtggactttacggttaacctgaacaggtcttggaaaaaggactttaaacattctcctgttctgtggaataagtatactttttttctggacatacaccttgtcagtgagtatgtatcataatt

SEQ ID NO: 426546 - DNA, 3872 bp, Homo sapiens
ccaaatcatagatcaagatattttatttatgtatgtcttttaaatgaagagtggttaggatagtcctgattattgcacataaatattgcctttcactagattattgttttgggccaaattttagactattattttaaaaaagagtaccttagtttaatccaacctttccagatacttagaaattattgaaatgtatattttgtgaagatggtcttatgaaagttgttgagctagaaacatgtccttcaccagtggaattcttagaagctttccttgggcttcactgggtgctaatagaccatgatcgtattgctctgtatataatggtacaaattttgttttataacactcagtcttaatagaatgggaatattttatcttactaacgtagtcattagctggccactctctgtgtccattggaccttatagggtaaagggagggcagtgcgtatttgaagcctgtgcacgtgacacacaaagggcttagcaacctccgtgttttcccagcacaggatacccattcttcctgaatgtttcattgttaaattagattgtgtgtgtgtgtgtgtgtgtgtgtgtgtattttatattaacatacagatgtatgtattttagttgcattttttttcttaaaatgttattttttctctttttcttttatgtcaggtgatgatagagcccctagggaagcaaaactgtccatgcccttgccttaactttcagatacgataaaaacaacatttataaaatacctgtcttagaaatattagctaaaattatgttggggaaagtatgtttgaaaatagaattgtaagctaccacattgtgataaatattactaaatttgtttattgacttgtcaggaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttataagttgaattactgggattaagtatgtgcacactttatatttatattttgaaaattattgcaagattgccttcaaaaatgtggttaacaactttatcttcaaatggcaatgaatgagattgccagctttcctacagcctcacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426547 - DNA, 4829 bp, Homo sapiens
ccctgtactctgtagattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattgggtgagatacaattccatggaattttaccactgaaccagtggagggctaattttgtcatttgtaccagttaactaacttgggaggaaacagaacaacacactcctgagattggttttcacagaattccatggactttaactgctgaaccaatgatgcactgattttgtcacttgtaccagctaacgcatctgggaggcaacaaaacaatactctcctgaggttaatgtggaccaaaaactagatttcatataaaagagtttattccttctacttgaggtgtgacatgaaggaaagtaatggaaataattctgccctcccattctcaagggccagggggaattcaaatattgaacggaagtgattttggaattgcatggaattctcactgccatcccaaagaaatgctgatcttgtcactcttacctgtttcattccctgggggcagaacaaaaggacgcactccaaagatcggcatgaaccaagaactgggtttcatataaaatattttattctgtcctcttgagatgtgacatgagaaaagtattgagaatacttctatcacctcatcttcaagaatccgtaggaattctcccatggtggactttacggttaacctgaacaggtcttggaaaaaggactttaaacattctcctgttctgtggaataagtatactttttttctggacatacaccttgtcagtgagttccatgtgatactagagttgcatagaatttttaacctttacgccaatgaagatctgaggcaaacattgccccttttttagaagtttgcatttgtcactgataactgtaataattgatctgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctgattggaagtgatattggtggaagacaacattttgccgcttggaattctcacctccacaccaaagaagtactgtttttgtcatttgcaccagcttctttctccaggaaagatcaaaacgatgcactgcaagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctccctctctctccctctctctctctcgctccctgacctctgcgtgtggactccaggcatgccatatacccctcaggacctgaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttataagttgaattactgggattaagtatgtgcacactttatatttatattttgaaaattattgcaagattgccttcaaaaatgtggttaacaactttatcttcaaatggcaatgaatgagattgccagctttcctacagcctcacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426548 - DNA, 4987 bp, Homo sapiens
ctgaaaatggagcgtagaagacatgcttcgatttccaggatggttgtgttttccagagaggcggaggtaaaccactggcgcagccctgcctcccacagataattccgggtgcagtgtttcatatctagacttggacttctatcctaccatacttctttgtgtgcagttcattgtggaaccagcacagattttcatacgaaagttatttctttttaacctcaaaaagtgacagaatggagtgtatcatgaaaaagtctgacatcaaaacctcaaaatgtgatattgattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattggttttcacagaattccatggactttaactgctgaaccaatgatgcactgattttgtcacttgtaccagctaacgcatctgggaggcaacaaaacaatactctcctgaggttaatgtggaccaaaaactagatttcatataaaagagtttattccttctacttgaggtgtgacatgaaggaaagtaatggaaataattctgccctcccattctcaagggccagggggaattcaaatattgaacggaagtgattttggaattgcatggaattctcactgccatcccaaagaaatgctgatcttgtcactcttacctgtttcattccctgggggcagaacaaaaggacgcactccaaagatcggcatgaaccaagaactgggtttcatataaaatattttattctgtcctcttgagatgtgacatgagaaaagtattgagaatacttctatcacctcatcttcaagaatccgtaggaattctcccatggtggactttacggttaacctgaacaggtcttggaaaaaggactttaaacattctcctgttctgtggaataagtatactttttttctggacatacaccttgtcagtgagttccatgtgatactagagttgcatagaatttttaacctttacgccaatgaagatctgaggcaaacattgccccttttttagaagtttgcatttgtcactgataactgtaataattgatctgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctgattggaagtgatattggtggaagacaacattttgccgcttggaattctcacctccacaccaaagaagtactgtttttgtcatttgcaccagcttctttctccaggaaagatcaaaacgatgcactgcaagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctccctctctctccctctctctctctcgctccctgacctctgcgtgtggactccaggcatgccatatacccctcaggacctgaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttataagttgaattactgggattaagtatgtgcacactttatatttatattttgaaaattattgcaagattgccttcaaaaatgtggttaacaactttatcttcaaatggcaatgaatgagattgccagctttcctacagcctcacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426549 - DNA, 4521 bp, Homo sapiens
gaggaaatgaattggacagtcatctataaatatcgtattttttaataaaatggctattcctttggtgcttggctggtagcatccatccactggtagtaaatagaccctggaaaaccagcacatatgtagtgagaccccatgagacatgattgtgcctacctttgagccatccataagttatctgggacatgacagtcttttgagtgagagcagtttactaaggtcatttagatcatcagttccaaagatggtgtggatcttatcgattatttttttaggcagaggtaatatctggaaaattaagagtgatttctaaccatgagaatattttagtttgtttaaatttgcttgctaacccagtaccaagaattcagaccttttttctgtctgtataaagcaatattctagacatttgagtgattcaagtagatgttgtgagatgattacatttccagtccttggaatgttatgtggattttattggctaatcttcatatttcatcagtggattttcctatgcatgttaagggagatccttgttaattgatgtctaggtggactttacggttaacctgaacaggtcttggaaaaaggactttaaacattctcctgttctgtggaataagtatactttttttctggacatacaccttgtcagtgagttccatgtgatactagagttgcatagaatttttaacctttacgccaatgaagatctgaggcaaacattgccccttttttagaagtttgcatttgtcactgataactgtaataattgatctgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctgattggaagtgatattggtggaagacaacattttgccgcttggaattctcacctccacaccaaagaagtactgtttttgtcatttgcaccagcttctttctccaggaaagatcaaaacgatgcactgcaagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctccctctctctccctctctctctctcgctccctgacctctgcgtgtggactccaggcatgccatatacccctcaggacctgaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttataagttgaattactgggattaagtatgtgcacactttatatttatattttgaaaattattgcaagattgccttcaaaaatgtggttaacaactttatcttcaaatggcaatgaatgagattgccagctttcctacagcctcacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426550 - DNA, 4781 bp, Homo sapiens
ccctgtactctgtagattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattgggtgagatacaattccatggaattttaccactgaaccagtggagggctaattttgtcatttgtaccagttaactaacttgggaggaaacagaacaacacactcctgagattggttttcacagaattccatggactttaactgctgaaccaatgatgcactgattttgtcacttgtaccagctaacgcatctgggaggcaacaaaacaatactctcctgaggttaatgtggaccaaaaactagatttcatataaaagagtttattccttctacttgaggtgtgacatgaaggaaagtaatggaaataattctgccctcccattctcaagggccagggggaattcaaatattgaacggaagtgattttggaattgcatggaattctcactgccatcccaaagaaatgctgatcttgtcactcttacctgtttcattccctgggggcagaacaaaaggacgcactccaaagatcggcatgaaccaagaactgggtttcatataaaatattttattctgtcctcttgagatgtgacatgagaaaagtattgagaatacttctatcacctcatcttcaagaatccgtaggaattctcccatggtggactttacggttaacctgaacaggtcttggaaaaaggactttaaacattctcctgttctgtggaataagtatactttttttctggacatacaccttgtcagtgagttccatgtgatactagagttgcatagaatttttaacctttacgccaatgaagatctgaggcaaacattgccccttttttagaagtttgcatttgtcactgataactgtaataattgatctgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctgattggaagtgatattggtggaagacaacattttgccgcttggaattctcacctccacaccaaagaagtactgtttttgtcatttgcaccagcttctttctccaggaaagatcaaaacgatgcactgcaagtgtgattggtccagatagctgccttatccaactgcctcctttggaccacttcatcatgggacagcttgatgcaatctacttgacaagaccctggaaccccagggaactcttgcctgcttgctttaaacccaccacttaaaagtctccacagaaaacctgtttgaatagtacccttgacccaataagggcattggcccctgggtgtctctctctctctctctctctctctccctctctctccctctctctctctcgctccctgacctctgcgtgtggactccaggcatgccatatacccctcaggacctgaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttataagttgaattactgggattaagtatgtgcacactttatatttatattttgaaaattattgcaagattgccttcaaaaatgtggttaacaactttatcttcaaatggcaatgaatgagattgccagctttcctacagcctcacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426551 - DNA, 4228 bp, Homo sapiens
agtgtgctttgtgtattggaggtaatactggaattgcatggaattcctactgctgctccagtaacctgctgattttgtcacgtgtaccagattcgttgtctggcaatgagaacaatacacttcagaggtaatatcggcatgaaccaagaactgggtttcatataaaatattttattctgtcctcttgagatgtgacatgagaaaagtattgagaatacttctatcacctcatcttcaagaatccgtaggaattctcccatggtggactttacggttaacctgaacaggtcttggaaaaaggactttaaacattctcctgttctgtggaataagtatactttttttctggacatacaccttgtcagtgagttccatgtgatactagagttgcatagaatttttaacctttacgccaatgaagatctgaggcaaacattgccccttttttagaagtttgcatttgtcactgataactgtaataattgatctgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctgattggaagtgatattggtggaagacaacattttgccgcttggaattctcacctccacaccaaagaagtactgtttttgtcatttgcaccagcttctttctccaggaaagatcaaaacgatgcactgcaagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctccctctctctccctctctctctctcgctccctgacctctgcgtgtggactccaggcatgccatatacccctcaggacctgaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttataagttgaattactgggattaagtatgtgcacactttatatttatattttgaaaattattgcaagattgccttcaaaaatgtggttaacaactttatcttcaaatggcaatgaatgagattgccagctttcctacagcctcacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426552 - DNA, 3810 bp, Homo sapiens
gtatgtttgtagccagtggggaattattttaactaggcaataatttgatctattttgggaagcctcttgtaatcaaatcatatatcaacattaatcacatggtgagtcctccatggttttcattcctagagattctaggatgtttgacatttctctgcttagcttatagcagaaaggtattggatatcaagaatgtttgaacagtttctcctttttgggaatgaagatgaaattgggctagaatgagatgtgtgattgagagaatgtccctgaggcctgagcagtgtgtccttttgggtatgggcattggaagcatgtagtgaattcttataattttatgttgcctcggcatccatcttgagtataagtttaactttgttataccagaagcaaggcttactcacttttgcacagtttccagttctacacctccttctcgttcctcagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctccctctctctccctctctctctctcgctccctgacctctgcgtgtggactccaggcatgccatatacccctcaggacctgaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttataagttgaattactgggattaagtatgtgcacactttatatttatattttgaaaattattgcaagattgccttcaaaaatgtggttaacaactttatcttcaaatggcaatgaatgagattgccagctttcctacagcctcacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426553 - DNA, 4771 bp, Homo sapiens
ccctgtactctgtagattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattgggtgagatacaattccatggaattttaccactgaaccagtggagggctaattttgtcatttgtaccagttaactaacttgggaggaaacagaacaacacactcctgagattggttttcacagaattccatggactttaactgctgaaccaatgatgcactgattttgtcacttgtaccagctaacgcatctgggaggcaacaaaacaatactctcctgaggttaatgtggaccaaaaactagatttcatataaaagagtttattccttctacttgaggtgtgacatgaaggaaagtaatggaaataattctgccctcccattctcaagggccagggggaattcaaatattgaacggaagtgattttggaattgcatggaattctcactgccatcccaaagaaatgctgatcttgtcactcttacctgtttcattccctgggggcagaacaaaaggacgcactccaaagatcggcatgaaccaagaactgggtttcatataaaatattttattctgtcctcttgagatgtgacatgagaaaagtattgagaatacttctatcacctcatcttcaagaatccgtaggaattctcccatggtggactttacggttaacctgaacaggtcttggaaaaaggactttaaacattctcctgttctgtggaataagtatactttttttctggacatacaccttgtcagtgagttccatgtgatactagagttgcatagaatttttaacctttacgccaatgaagatctgaggcaaacattgccccttttttagaagtttgcatttgtcactgataactgtaataattgatctgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctgattggaagtgatattggtggaagacaacattttgccgcttggaattctcacctccacaccaaagaagtactgtttttgtcatttgcaccagcttctttctccaggaaagatcaaaacgatgcactgcaagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctccctctctctccctctctctctctcgctccctgacctctgcgtgtggactccaggcatgccatatacccctcaggacctgaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttataagttgaattactgggattaagtatgtgcacactttatatttatattttgaaaattattgcaagattgccttcaaaaatgtggttaacaactttatcttcaaatggcaatgaatgagattgccagctttcctacagcctcacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426554 - DNA, 4775 bp, Homo sapiens
ccctgtactctgtagattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattgggtgagatacaattccatggaattttaccactgaaccagtggagggctaattttgtcatttgtaccagttaactaacttgggaggaaacagaacaacacactcctgagattggttttcacagaattccatggactttaactgctgaaccaatgatgcactgattttgtcacttgtaccagctaacgcatctgggaggcaacaaaacaatactctcctgaggttaatgtggaccaaaaactagatttcatataaaagagtttattccttctacttgaggtgtgacatgaaggaaagtaatggaaataattctgccctcccattctcaagggccagggggaattcaaatattgaacggaagtgattttggaattgcatggaattctcactgccatcccaaagaaatgctgatcttgtcactcttacctgtttcattccctgggggcagaacaaaaggacgcactccaaagatcggcatgaaccaagaactgggtttcatataaaatattttattctgtcctcttgagatgtgacatgagaaaagtattgagaatacttctatcacctcatcttcaagaatccgtaggaattctcccatggtggactttacggttaacctgaacaggtcttggaaaaaggactttaaacattctcctgttctgtggaataagtatactttttttctggacatacaccttgtcagtgagttccatgtgatactagagttgcatagaatttttaacctttacgccaatgaagatctgaggcaaacattgccccttttttagaagtttgcatttgtcactgataactgtaataattgatctgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctgattggaagtgatattggtggaagacaacattttgccgcttggaattctcacctccacaccaaagaagtactgtttttgtcatttgcaccagcttctttctccaggaaagatcaaaacgatgcactgcaagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctccctctctctccctctctctctctcgctccctgacctctgcgtgtggactccaggcatgccatatacccctcaggacctgaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttataagttgaattactgggattaagtatgtgcacactttatatttatattttgaaaattattgcaagattgccttcaaaaatgtggttaacaactttatcttcaaatggcaatgaatgagattgccagctttcctacagcctcacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426555 - DNA, 3305 bp, Homo sapiens
ctgaaaatggagcgtagaagacatgcttcgatttccaggatggttgtgttttccagagaggcggaggtaaaccactggcgcagccctgcctcccacagataattccgggtgcagtgtttcatatctagacttggacttctatcctaccatacttctttgtgtgcagttcattgtggaaccagcacagattttcatacgaaagttatttctttttaacctcaaaaagtgacagaatggagtgtatcatgaaaaagtctgacatcaaaacctcaaaatgtgatattgattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattggttttcacagaattccatggactttaactgctgaaccaatgatgcactgattttgtcacttgtaccagctaacgcatctgggaggcaacaaaacaatactctcctgaggttaatgtggaccaaaaactagatttcatataaaagagtttattccttctacttgaggtgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttataagttgaattactgggattaagtatgtgcacactttatatttatattttgaaaattattgcaagattgccttcaaaaatgtggttaacaactttatcttcaaatggcaatgaatgagattgccagctttcctacagcctcacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426556 - DNA, 2287 bp, Homo sapiens
ccctgtactctgtagattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattgggtgagatacaattccatggaattttaccactgaaccagtggagggctaattttgtcatttgtaccagttaactaacttgggaggaaacagaacaacacactcctgagattggttttcacagaattccatggactttaactgctgaaccaatgatgcactgattttgtcacttgtaccagctaacgcatctgggaggcaacaaaacaatactctcctgaggttaatgtggaccaaaaactagatttcatataaaagagtttattccttctacttgaggtgtgacatgaaggaaagtaatggaaataattctgccctcccattctcaagggccagggggaattcaaatattgaacggaagtgattttggaattgcatggaattctcactgccatcccaaagaaatgctgatcttgtcactcttacctgtttcattccctgggggcagaacaaaaggacgcactccaaagatcggcatgaaccaagaactgggtttcatataaaatattttattctgtcctcttgagatgtgacatgagaaaagtattgagaatacttctatcacctcatcttcaagaatccgtaggaattctcccatggtggactttacggttaacctgaacaggtcttggaaaaaggactttaaacattctcctgttctgtggaataagtatactttttttctggacatacaccttgtcagtgagttccatgtgatactagagttgcatagaatttttaacctttacgccaatgaagatctgaggcaaacattgccccttttttagaagtttgcatttgtcactgataactgtaataattgatctgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctgattggaagtgatattggtggaagacaacattttgccgcttggaattctcacctccacaccaaagaagtactgtttttgtcatttgcaccagcttctttctccaggaaagatcaaaacgatgcactgcaagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctccctctctctccctctctctctctcgctccctgacctctgcgtgtggactccaggcatgccatatacccctcaggacctgtaagtaatactatctttatttttattttatatctctcctaatcattgaaaaggtgctctctatcttgaagatactatattaaataaaatgagaacttgtccctaacacagttagtgataggctgaaacacgctgattgcactctttacccatttagtgatttttctcaagttactctacaccatgtattatcaacataattgatattacagaatagaattataagacacttcttttgccacagaaagttctattggactcagattatctagagctactacatgtatgctattctatgataaaagatgtagatgtgataaaaacatttataaaatatctgtcttagaaaagttagctaaaattattttgggaaaagtatgtttgaaaatagaatcgtaagctaccacattgtgataaatatttctaaatgtgtctattaacttgtcaggagacaacagagtgaat

SEQ ID NO: 426557 - DNA, 1862 bp, Homo sapiens
cgatatagaggatccccaagcagttatacagactccaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426558 - DNA, 2141 bp, Homo sapiens
ccctgtactctgtagattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattgggtgagatacaattccatggaattttaccactgaaccagtggagggctaattttgtcatttgtaccagttaactaacttgggaggaaacagaacaacacactcctgagattggttttcacagaattccatggactttaactgctgaaccaatgatgcactgattttgtcacttgtaccagctaacgcatctgggaggcaacaaaacaatactctcctgaggttaatgtggaccaaaaactagatttcatataaaagagtttattccttctacttgaggtgtgacatgaaggaaagtaatggaaataattctgccctcccattctcaagggccagggggaattcaaatattgaacggaagtgattttggaattgcatggaattctcactgccatcccaaagaaatgctgatcttgtcactcttacctgtttcattccctgggggcagaacaaaaggacgcactccaaagatcggcatgaaccaagaactgggtttcatataaaatattttattctgtcctcttgagatgtgacatgagaaaagtattgagaatacttctatcacctcatcttcaagaatccgtaggaattctcccatggtggactttacggttaacctgaacaggtcttggaaaaaggactttaaacattctcctgttctgtggaataagtatactttttttctggacatacaccttgtcagtgagttccatgtgatactagagttgcatagaatttttaacctttacgccaatgaagatctgaggcaaacattgccccttttttagaagtttgcatttgtcactgataactgtaataattgatctgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctgattggaagtgatattggtggaagacaacattttgccgcttggaattctcacctccacaccaaagaagtactgtttttgtcatttgcaccagcttctttctccaggaaagatcaaaacgatgcactgcaagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctccctctctctccctctctctctctcgctccctgacctctgcgtgtggactccaggcatgccatatacccctcaggacctgaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtaagatgttagttaaaatagtccttgctttctgggagaagccatgtcttagtagaaattgagctgttaattttccgaatattgatgatgtttgatta

SEQ ID NO: 426559 - DNA, 1109 bp, Homo sapiens
ccctgtactctgtagattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattgggtgagatacaattccatggaattttaccactgaaccagtggagggctaattttgtcatttgtaccagttaactaacttgggaggaaacagaacaacacactcctgagattggttttcacagaattccatggactttaactgctgaaccaatgatgcactgattttgtcacttgtaccagctaacgcatctgggaggcaacaaaacaatactctcctgaggttaatgtggaccaaaaactagatttcatataaaagagtttattccttctacttgaggtgtgacatgaaggaaagtaatggaaataattctgccctcccattctcaagggccagggggaattcaaatattgaacggaagtgattttggaattgcatggaattctcactgccatcccaaagaaatgctgatcttgtcactcttacctgtttcattccctgggggcagaacaaaaggacgcactccaaagatcggcatgaaccaagaactgggtttcatataaaatattttattctgtcctcttgagatgtgacatgagaaaagtattgagaatacttctatcacctcatcttcaagaatccgtaggaattctcccatggtaagcattttgtcctgaaaatactggcattcctcttaggagatcgtgacactccaatgaccatgagaccctggccatgctagtcagccattggccagtcattgactgtgatgccagtctccataattgaatgaatagtgtgggtcagtgtaccccaagctgatggaaagctgtgtgctcagtgtctgtcacatatcccaggcttaaggtaccttttataaatgtacctggattgacgatgacttta

SEQ ID NO: 426560 - DNA, 242 bp, Homo sapiens
tcccacagataattccgggtgcagtgtttcatatctagacttggacttctatcctaccatacttctttgtgtgcaggtatttttggggataaaatccttgttttcagctgtatagatgtcttgcacatactcttttgatggtttgatttatccattgtgttcagcacgtttcagtgagcaagatatgggatttaatttccaatataaaatccatgactgctggccgggcgcagtggcttatg

SEQ ID NO: 426561 - DNA, 419 bp, Homo sapiens
tacctgtggtctcttggacacccttgcaggtatgtgggcagggaactgcatgtttataggaaacaggcctaggatggaaggagttaatagatcttgctcttcttgagtttgatgacatttgtttccagttaaatagcatgaaaacccatctgagagccagctgagggtggatacagttctggggagttaaagacgagtggtcacaacaggtcttcctcggcaatccgagcccaaaactgaatctgcctccataagaccattatgtgtcagctctttatttatatgattgattcatccagtggacttttaatttcttatgtccagatattttttcagttctttttttcgtgatacaagcaccttgtggattgcctgtcatagaacaggttctcaataaacttttattgaaaaaagatgta

SEQ ID NO: 426562 - DNA, 203 bp, Homo sapiens
agtgtggcctggtatccacagtgcaccccgtgctggtgggtggctcaggacggtaagcattcctctgcccttcgtgctgagtgagggtgtctttgggattcccaagacccacaatgaacagtttttcagtaggccactaatggcatgctgagttcctctcctagagtggatggtctgtaccttttgctcagtggcacagctct

SEQ ID NO: 426563 - DNA, 792 bp, Homo sapiens
gttggggttttcacttttcatttctctattaagtgaaaaaagtatatgaaaattgaaaaatagatattacttatgtaatcttcacagtataatttgcttgccaagcagtcactgggatttaatcagtttctttgtctttcgtttttctcataagctgagagagtaattttgtgtgcacagaagtactgtcttcagctacatgctgcattaaacattcctagatgtgaaatgattaaatttccaagtttttaaaatgtggatttttctggccacttttatatctcttcaatgggtttctaatggatttaaggagagagcctagtcatgatgaatggtgttgtgttgggtatgctgaggaaactttgagaccaatgtttcagaaaaaattatttctatactgtcatgtttcaagtaccgagtattgttcttgtcatacagatggtccagtgaacatctctggtgaattccttacaaccaacctcttgttactaaatattccattaggaatgttttgtttctcaactccctgatttcccctttatagattggaagtgatattggtggaagacaacattttgccgcttggaattctcacctccacaccaaagaagtactgtttttgtcatttgcaccagcttctttctccaggaaagatcaaaacgatgcactgcaaggttaacatccaatttttaatacatgtaattccctggattatttttgttgtgttattaaataacttagaattttttttacaaagtctgttgaaccaaacactgtaaggcattaataacc

SEQ ID NO: 426564 - DNA, 3351 bp, Homo sapiens
agtgggtggaaatgcagacctaggggagtgtgcggctggccttggcttggggcagttgccgtgggaggcccgctgcctgctggaaggaagatggtcagttcttctgaaccacaaaggccctgcagagtcctggagtctgtgtggcctggcttccagggttcacctcatgctggtggattgctcaggatgggtgccgaaggtctttaaggtcgtcagctcacctactgcccagcctgtggtgtcaaatgtcctgcctcttcaaatgtgtttggatcgatgatgagtccccccaaaaaaacattccttggaaaagctgaacaaaatgagtgaaaactcataccgtcgttctcagcggaactgagatccagcgcgttgcctccagcagggactgttggagtgagggagagcttccactagtccctataggttccaccacccagggcatccgcaggggcagttgccatgggaggcgcaggcctgctggaaggaagatggtcgattctcccaagcaacaaaggccacgtagagtcctggtttcagtgtggcctggtatccacagtgcaccccgtgctggtgggtggctcaggacgcacactcatttcctctgcaccttcctggtgtcattggcatggaaggaaggcccttgtccaagaaggatggtcttcgtcttgtgtgatctttgagatggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacacggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttataagttgaattactgggattaagtatgtgcacactttatatttatattttgaaaattattgcaagattgccttcaaaaatgtggttaacaactttatcttcaaatggcaatgaatgagattgccagctttcctacagcctcacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttatttacaagtttcaactaatgaaattgactgtgattttcttttgggctattttg

SEQ ID NO: 426565 - DNA, 666 bp, Homo sapiens
ccgtaaagagtttgtagaggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatggtcgtcccgcaatgcttttgaatgtgctggatgtcatggagggccggtgacatctagcggggaggtgggcggcgagggtcccggcgggagccaataaagttggtgaaaatcgttgtaa

SEQ ID NO: 426566 - DNA, 3323 bp, Homo sapiens
ccgtaaagagtttgtagaggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatggtcgtcccgcaatgcttttgaatgtgctggatgtcatggagggccggtgacatctagcggggagccttcgctctcctgccagtttgtgagcactcaggaccaagttctgggaagataccgtcggatcgagctgagctcggggcaggaagtgtctgcggccatatttttcaaaaagtggagtaactttccgtcttggaagggtggctctgatggcacgatgtcaacttgagattcttcctagcctagtagctgctgtgctttcatgctttggatatcagatatctttatatagcacttttatgttcatattttttttttaatgaaggaaacgttcaataagtgagtcatgaggttggaaattcgttcccctgacagtcatattgcataacattgcagcgcctttagtcgtgggttacatatgcttgagcttttaaagtgatgttgtcaagtttctagcttcataatgatcctgtcttcatcatatcatattcactttgagaatcggtttgactttgctttcaaacaaaacaaaaacctcttgcttttaggggttcttacccaacaaataacctgtttgaactctcttatattctcccactagcctgaagcaatgacctcattccagtaatgtctttgggagttgcattgcctaatggcacaatattgctttaataaacatgtaaggaaagataggaccaaatatgtaagtgcagggggaaacacatttcagaccaggaatccacattgaaaagttaacactagtaatcatcttctgcccttaattgacactcctatttatttcatcctcagcaaatttcatcctggctcacagaccccacaaaaaagatcccagtacagatttcacatctttggattcatctttcctgtgagtcggaattgaagtcttccccaaaaatatatgtatatattgtatgtcttcatccttggtagcggctggcccattttcccacatggactttattttgtccccagtatttattgaacagctgtctatgccaggctctgtacaaagtgataggagtagagctgtgaatgaggccaaccagatttccactctctcggagctcactttatttttattggttcctgaagacgggacaaggaacaaatacatacgttaatatgagagatcagcttctgttagtacttgtacctctctgctgtgtgtggatgaatgatggaattacttctcccatgttgccatttttgaggtgtacaaaggtcaggccgtacacacctctgttaggaggcaaattattgggcaggttcgagatgttctgctatttactctgtggttttgtcatatgtaaaagtcataacacctgttttaaggattgagattgttcatttactgtgtgccacatattagacaataaatggaaaaaagtaccatgttcaatgggggtatgggtttatccttataggttaaattataggtaaacattaataggactttttaaaaaatgcctcattgttagaactactactcacagttaccacttggggtcagtggaacaaaatgcatatatggttttgacatttgagtctaaatttcttaaagggatgaggcatctgagggattgttaccaaaatgatgaagaaataaggacaagggacatcaagacattcataagaaaaagcacctttgccttcccctgggaagattcacaggaatctgtccagctcttgttacatgatgagcaacatagacaagatacgaggcattgtaactgccctgtcgccacccgcctctcccaccactacccaaaggattcttagcatcccctcacatactctgcctgcctcaacgttcagtcagcccctcaccatttttgtttttgagagttttttttttaacccgaatagtttactggctgtttaaaatgcatactcctacaaaatcagctcagcccatgatccatgatgaacaaacagtagttcttgctgatgtgtgattatgaatttaaaaggccagtatttctttaagcataagaccatatggaaaaaggcctaagacaaaatctgatgggaactgaattccagtttttaatagagttataatccatagttttatttacacacaaacacacacacacacactctttcctgcagagataagcaagccgttcagtgtggctgtggcttggccaggatttgtttgatctttgtttttcctgcagggccagtcttgtctttgtgtccccgaggactggtctgtttagttgtgcctgcctggaatcaaaaggcttagtcaggccccataattggtgatgactggcatactatatgcaaacttcacaatgccccttccagtggttgaaaggtcgcataccatgctgtgtaagaactttagctctctggcaatgagacttaaattcagattcactctactccttattagttatctgatttttggaaacttaatctctttaaacctcagtttcatctctaaaatgggcataatagtttacctcatagagtttggggagaattgagtgaattaatgtgtgtgaggacactaagattcccatatagaaataggctcaatgaatagtagctgtttttatttctatgtaaagtgagtagcggtagttgatgggagctgttgaaacaggtaaacagcattctagcaatccttcgacttttgtgatagcaaaccataaaaacaattttagtggctgttttactaattaaaggacatccacaattcaatgtataacagaaaaagtaatgattaaagcttgtgaatctgaa

SEQ ID NO: 426567 - DNA, 2265 bp, Homo sapiens
ccgtaaagagtttgtagaggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgagccttcgctctcctgccagtttgtgagcactcaggaccaagttctgggaagataccgtcggatcgagctgagctcggggcaggaagtgtctgcggccatatttttcaaaaagtggagtaactttccgtcttggaagggtggctctgatggcacgatgtcaacttgagattcttcctagcctagtagctgctgtgctttcatgctttggatatcagatatctttatatagcacttttatgttcatattttttttttaatgaaggaaacgttcaataagtgagtcatgaggttggaaattcgttcccctgacagtcatattgcataacattgcagcgcctttagtcgtgggttacatatgcttgagcttttaaagtgatgttgtcaagtttctagcttcataatgatcctgtcttcatcatatcatattcactttgagaatcggtttgactttgctttcaaacaaaacaaaaacctcttgcttttaggggttcttacccaacaaataacctgtttgaactctcttatattctcccactagcctgaagcaatgacctcattccagtaatgtctttgggagttgcattgcctaatggcacaatattgctttaataaacatgtaaggaaagataggaccaaatatgtaagtgcagggggaaacacatttcagaccaggaatccacattgaaaagttaacactagtaatcatcttctgcccttaattgacactcctatttatttcatcctcagcaaatttcatcctggctcacagaccccacaaaaaagatcccagtacagatttcacatctttggattcatctttcctgtgagtcggaattgaagtcttccccaaaaatatatgtatatattgtatgtcttcatccttggtagcggctggcccattttcccacatggactttattttgtccccagtatttattgaacagctgtctatgccaggctctgtacaaagtgataggagtagagctgtgaatgaggccaaccagatttccactctctcggagctcactttatttttattggttcctgaagacgggacaaggaacaaatacatacgttaatatgagagatcagcttctgttagtacttgtacctctctgctgtgtgtggatgaatgatggaattacttctcccatgttgccatttttgaggtgtacaaaggtcaggccgtacacacctctgttaggaggcaaattattgggcaggttcgagatgttctgctatttactctgtggttttgtcatatgtaaaagtcataacacctgttttaaggattgagattgttcatttactgtgtgccacatattagacaataaatggaaaaaagtaccatgttcaatgggggtatgggtttatccttataggttaaattataggtaaacattaataggactttttaaaaaatgcctcattgttagaactactactcacagttaccacttggggtcagtggaacaaaatgcatatatggttttgacatttgagtctaaaatgggcataatagtttacctcatagagtttggggagaattgagtgaattaatgtgtgtgaggacactaagattcccatatagaaataggctcaatgaatagtagctgtttttatttctatgtaaagtgagtagcggtagttgatgggagctgttgaaacaggtaaacagcattctagcaatccttcgacttttgtgatagcaaaccataaaaacaattttagtggctgttttactaattaaaggacatccacaattcaatgtataacagaaaaagtaatgattaaagcttgtgaatctgaa

SEQ ID NO: 426568 - DNA, 3261 bp, Homo sapiens
ccgtaaagagtttgtagaggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatgagccttcgctctcctgccagtttgtgagcactcaggaccaagttctgggaagataccgtcggatcgagctgagctcggggcaggaagtgtctgcggccatatttttcaaaaagtggagtaactttccgtcttggaagggtggctctgatggcacgatgtcaacttgagattcttcctagcctagtagctgctgtgctttcatgctttggatatcagatatctttatatagcacttttatgttcatattttttttttaatgaaggaaacgttcaataagtgagtcatgaggttggaaattcgttcccctgacagtcatattgcataacattgcagcgcctttagtcgtgggttacatatgcttgagcttttaaagtgatgttgtcaagtttctagcttcataatgatcctgtcttcatcatatcatattcactttgagaatcggtttgactttgctttcaaacaaaacaaaaacctcttgcttttaggggttcttacccaacaaataacctgtttgaactctcttatattctcccactagcctgaagcaatgacctcattccagtaatgtctttgggagttgcattgcctaatggcacaatattgctttaataaacatgtaaggaaagataggaccaaatatgtaagtgcagggggaaacacatttcagaccaggaatccacattgaaaagttaacactagtaatcatcttctgcccttaattgacactcctatttatttcatcctcagcaaatttcatcctggctcacagaccccacaaaaaagatcccagtacagatttcacatctttggattcatctttcctgtgagtcggaattgaagtcttccccaaaaatatatgtatatattgtatgtcttcatccttggtagcggctggcccattttcccacatggactttattttgtccccagtatttattgaacagctgtctatgccaggctctgtacaaagtgataggagtagagctgtgaatgaggccaaccagatttccactctctcggagctcactttatttttattggttcctgaagacgggacaaggaacaaatacatacgttaatatgagagatcagcttctgttagtacttgtacctctctgctgtgtgtggatgaatgatggaattacttctcccatgttgccatttttgaggtgtacaaaggtcaggccgtacacacctctgttaggaggcaaattattgggcaggttcgagatgttctgctatttactctgtggttttgtcatatgtaaaagtcataacacctgttttaaggattgagattgttcatttactgtgtgccacatattagacaataaatggaaaaaagtaccatgttcaatgggggtatgggtttatccttataggttaaattataggtaaacattaataggactttttaaaaaatgcctcattgttagaactactactcacagttaccacttggggtcagtggaacaaaatgcatatatggttttgacatttgagtctaaatttcttaaagggatgaggcatctgagggattgttaccaaaatgatgaagaaataaggacaagggacatcaagacattcataagaaaaagcacctttgccttcccctgggaagattcacaggaatctgtccagctcttgttacatgatgagcaacatagacaagatacgaggcattgtaactgccctgtcgccacccgcctctcccaccactacccaaaggattcttagcatcccctcacatactctgcctgcctcaacgttcagtcagcccctcaccatttttgtttttgagagttttttttttaacccgaatagtttactggctgtttaaaatgcatactcctacaaaatcagctcagcccatgatccatgatgaacaaacagtagttcttgctgatgtgtgattatgaatttaaaaggccagtatttctttaagcataagaccatatggaaaaaggcctaagacaaaatctgatgggaactgaattccagtttttaatagagttataatccatagttttatttacacacaaacacacacacacacactctttcctgcagagataagcaagccgttcagtgtggctgtggcttggccaggatttgtttgatctttgtttttcctgcagggccagtcttgtctttgtgtccccgaggactggtctgtttagttgtgcctgcctggaatcaaaaggcttagtcaggccccataattggtgatgactggcatactatatgcaaacttcacaatgccccttccagtggttgaaaggtcgcataccatgctgtgtaagaactttagctctctggcaatgagacttaaattcagattcactctactccttattagttatctgatttttggaaacttaatctctttaaacctcagtttcatctctaaaatgggcataatagtttacctcatagagtttggggagaattgagtgaattaatgtgtgtgaggacactaagattcccatatagaaataggctcaatgaatagtagctgtttttatttctatgtaaagtgagtagcggtagttgatgggagctgttgaaacaggtaaacagcattctagcaatccttcgacttttgtgatagcaaaccataaaaacaattttagtggctgttttactaattaaaggacatccacaattcaatgtataacagaaaaagtaatgattaaagcttgtgaatctgaa

SEQ ID NO: 426569 - DNA, 878 bp, Homo sapiens
ccgtaaagagtttgtagaggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatggtcgtcccgcaatgcttttgaatgtgctggatgtcatggagggccggtgacatctagcggggaggtgggcggcgagggtcccggcgggagccaataaagttggtgaaaatcgttgtaaggtcgagagagctgtgtagtcgcggggacatgtcggatggccccaggggaggggggcgaccgggaaacccctggagcaggcactggtgggtgggcttgagccactctggacggctttagtccgcaggtcaccctcgaggcgtcaggggagggtggcctggaggtgggcagggtggaagccacctcgctgtcagtagggcaaaggggaggcag

SEQ ID NO: 426570 - DNA, 2883 bp, Homo sapiens
gaatcagtttgtttctcttggatcgatgtgtttcccagaggcagtgcttcttagtgatgaaagaaatattttatcaaatgtagatgatatcttagcagctacagcagcagcttgtggagttacacctactgatttttccaagtcaacttcaaatgaaaccatgcaggctgttgaagatggtgattctaaatctcattttcagcagtcattagatgtcaggcatgtgacttcagattttaactctatgacagctacagtaggaaagccacagaatataaatgatacttccttaaatggaaatcaggttactgtgaacctttcaccagtacctgcccttcagtcaaaaatgactcttgatcaacagcacattgaaacacctggtcaaaatataccaactaaagtaacttcagcagtggttggaccaagtcatgaagtccaggagcaaagttctggcccattcaagaaacagtctgctaccaatcttgaatctgaagaagacagtgaagctcctgttgatagtacattaaataataacagaaaccaagagtttgtttctagtagtagaagtataagtggagagagtgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcattttaaccttcaaaagaaaagagctaaaggaaaagggcaagttaaagaggaagacaacagtaatcagaaacagctgaaaagacctgcccaaggcaaacgccagaatccaaggggaacagatatttacttaccgtatactcctccttcctcagaaagctgccatgatggttatcagcatcaagaaaaaatgagacagaagatcaaagaggtggaggaaaaacaaccagaagtcaaaacaggatttattgcttctttcttagattttctgaaatccgggcccaagcagcagttttccactcttgctgtacgaatgcctaacaggactagacggccagggacccagatggttcgtacattttgtcccccaccacttcccaagccttcatctacaacacccacacctttagtgtctgaaactggcggtaacagtccatcagataaagttgataatgaacttaaaaacttggaacatttatcttcattttcttctgatgaagatgatcctggatatagtcaagatgcttataaaagcgtctctactcccttaactactttggatgctacttctgataaaaagaagaaaacagaagccctacaggtggcaactactagcccaactgccaatactactggtactgctactacttcctcaaccactgtgggtgcagttaagcaagaacctctccactctacttcatatgcagtaaatattctggaaaatataagctcttcagaatcctcaaagcccattgaacttgatggtcttccttcagaccagtttgcaaaaggacaggacactgttgccatagaaggttttacagatgaggaggacacagaaagcggaggagaaggccaatacagagagcgtgatgaatttgtggtaaagatagaagacatagagacttttaaggaggctttaaaaacaggaaaagaacctccagctatttggaaagtacaaaaagctttattacagaaatttgttcctgaaattcgagatggtcaaagagaatttgctgctacaaatagttatcttggatattttggagatgcaaagagtaaatacaaaagaatatatgtgaagttcattgaaaatgcaaacaagaaggaatatgtcagagtgtgttctaaaaagccaagaaataaaccttcacaaactatcagaactgttcaagctaagccaagtagtagcagtaaaacttctgatcctctagcatcaaaaactacaactacaaaagccccttccgtgaaacccaaagttaaacagccaaaagtaaaggctgagccaccaccaaagaaacggaaaaaatggaaagaagaattttcatcatcccaatctgactcatctcctgagatccatactagtagtagtgacgatgaggaatttgaacctcccgctccctttgtcactcgctttttgaacacaagagcaatgaaggaaacctttaagagctacatggaattgcttgttagcattgccttggaccctgacacaatgcaagccttagagaagagcaatgatgagctacttttacctcatatgaaaaaaatagatggcatgctaaatgataaccgaaagagacttcttttgaatcttcatttggatcaatcattcaagaatgctttggaaagttttcctgaactaacaataattactcgagattctaaagcaaagagtggaggaactgctatttctaaaatcaaaatgaatggcaaagcctataataagaaaactctaaggacttctaaaacaaccaccaaatctgcacaagagtttgctgtcgatccagagaaaatacagttgtattctttgtatcattcactccatcattataagtaccatgtttatctgatatgtaaggatgaggtactttcttctcatttacttaaaaaaaatgtttttcagaatgttaaggagactctagccatagtattttggagtgttttaaagagagttgtgaaatacatgtgtgtatgtattttgtctatgtattctgtaaataatgacttgatttattgttctgagtctctctgctatgttttgtgctcagatttacccgagcctcaccacctcttgtaggagctataattggtaatgttttgaagctgttggtgcttgctttacatcgccataataaatgatgttttattgca

SEQ ID NO: 426571 - DNA, 2966 bp, Homo sapiens
taatgtgaattctatcttgaggtaaccatttttttcatacagatttgcttcagtgttatccagaatatgcattcagtactagaattagtttagctttataaatagggctgtgttagacactgcagtaattttctaattcataaaataaacttcttactaaactagcacttgattaacttgttgaggtaaaaatctaactacatttacattttgaagaataaaactgataattagactatttgcagtgttaaacacagcttccttaactcttagaactggaagttgtagagctctccttttggtgcctttccagcctttatacacactattgtagctttcttaggtttgataggtagcgtttcaagtagtttagctgagacagtgaatgtattaggttcaacatgaccttgtgttttatttgtgtttgccaacaggatgccttatttgtttgagaaaaagatgtactagtgtcattctaaactatctccttttttaggattctaaagaagttaatcatcatccttttgtttattttaccaccatttagtgccttaaatcctatcaagaaagcagtgttactgctcaatgcccaaataagacacgcggatattgctattgtcttgcttttgagttaacaggccaactttttatacttaaaacctcagtaaactggcaaagaattgaaggtaatgtgatttgatttgagaataaaacattgtagcattgggtgaaaaatgagtatttgagttaagcttacatatttatttctgatggttatcttattaaaagcaataatccttaatactgtacttgccattagactaggtactcagtaatggaagtttctctcaagggttaaatgttccatttttgaaagttttaaaaaacctgtttgggtggtttattttgaaaacaaaagtaacctattagattcattttgcctaactcatatggagagcatgcagagtatcaacagtgggagcatcataaaatgaattttccaagtggagaggagtaggaagcagccatatgatagtattgactctggacagaattgatgtctttcgtttccaaagtgcagagtagggaactacatttcctaatgtggcattgtaaatatacatctttatattactcttccagcctacgttcctaaatcattgataatttaaatattttttaaagccaccttaatttaggtagctcttggaatcgatgtttgaattcactagccacattttcttcatgatatgcctcgtggcaaacaaagatgtttccttaagatgaatcttacatttcccatagaaaataacccatttcctttggcactgcagttgccctcaaactgcttgcagttgtattcattttagtacaacaaaggttttcataatatgggaggccaagtctatgatactgcctcaaagagaccctattgtgtagatgcatcatcttctctcatttgatccatagagcataggcaaagatgtcaacctcaggccttagagaaaagtggaaatgttattatgacagccgtccatgagttatcgctttgtatgaagttaaatacagtcatgcgttgcttaacagcagggatacattctgagaaatgcattgttaggcaattccgttgtgcgaacatcctagtgtacttacacaaacctaggtggcatagcccacaacgtacccaggctatatggtaaacctgtacagcatgttactgtactgaatactgtaggcagttgtaacacaatggtatttgtgtatctagacatagaaaacatacagtaagaatatggtattataatcttacgggaccactgtcaaatacgcggtctgtctttgaaaagttgtaatgcggcgcatgactataaatacctagctggttagcatttacattccttgccagggagtttgaaatttatactatagaaataactttaggttttaggtagagttaaagaggtaaagcacatgttgccacaacccaggaaagtatttttaagaaagattggattttcctacctttagagatctaaaaaaaatttaatataaaaaatcattttgtgttggtgtttattactagttcagatgagtggctgctgaaggggcccccttgtcattttcattataacccaatttccacttatttgaactcttaagtcataaatgtataatgacttatgaattagcacagttaagttgacactagaaactgcccatttctgtattacactatcaaataggaaacattggaaagatggggaaaaaaatcttattttaaaatggcttagaaagttttcagattactttgaaaattctaaacttctttctgtttccaaaacttgaaaatatgtagatggactcatgcattaagactgttttcaaagctttcctcacatttttaaagtgtgattttccttttaatatacatatttattttctttaaagcagctatatcccaacccatgactttggagatatacctataaaaccaatataacagcagggttattgaagcagctttctcaaatgttgcttcagatgtgcaagttgcaaattttattgtatttgtagaatacaatttttgttttaaactgtatttcaatctatttctccaagatgcttttcatatagagtgaaatatcccaggataactgcttctgtgtcagtcgcatttgacgcataactgcacaaatgaacagtgtatactcttggttgtgcattaacttacatgtataatttttggcatctgtgttcacaaatgcatgtgttagcaaatcacctttatttataagtgacaataattgaagttaaggatataaagaaacctgcatttgtagtccagcgttttcatttggtccataacacaatgtatggaaatgtgaaagacaattttgtacatttgtttgttactaactcagatcattaaaatgaaaacaatttttttaaacaagaaaaaaaaaatg

SEQ ID NO: 426572 - DNA, 2712 bp, Homo sapiens
tagtttagctgagacagtgaatgtattaggttcaactacttgaaacgctacctatcaaacctaagaaagctacaatagtgtgtataaaggctggaaaggtagcgtttcaagtagtttagctgagacagtgaatgtattaggttcaacatgaccttgtgttttatttgtgtttgccaacaggatgccttatttgtttgagaaaaagatgtactagtgtcattctaaactatctccttttttaggattctaaagaagttaatcatcatccttttgtttattttaccaccatttagtgccttaaatcctatcaagaaagcagtgttactgctcaatgcccaaataagacacgcggatattgctattgtcttgcttttgagttaacaggccaactttttatacttaaaacctcagtaaactggcaaagaattgaaggtaatgtgatttgatttgagaataaaacattgtagcattgggtgaaaaatgagtatttgagttaagcttacatatttatttctgatggttatcttattaaaagcaataatccttaatactgtacttgccattagactaggtactcagtaatggaagtttctctcaagggttaaatgttccatttttgaaagttttaaaaaacctgtttgggtggtttattttgaaaacaaaagtaacctattagattcattttgcctaactcatatggagagcatgcagagtatcaacagtgggagcatcataaaatgaattttccaagtggagaggagtaggaagcagccatatgatagtattgactctggacagaattgatgtctttcgtttccaaagtgcagagtagggaactacatttcctaatgtggcattgtaaatatacatctttatattactcttccagcctacgttcctaaatcattgataatttaaatattttttaaagccaccttaatttaggtagctcttggaatcgatgtttgaattcactagccacattttcttcatgatatgcctcgtggcaaacaaagatgtttccttaagatgaatcttacatttcccatagaaaataacccatttcctttggcactgcagttgccctcaaactgcttgcagttgtattcattttagtacaacaaaggttttcataatatgggaggccaagtctatgatactgcctcaaagagaccctattgtgtagatgcatcatcttctctcatttgatccatagagcataggcaaagatgtcaacctcaggccttagagaaaagtggaaatgttattatgacagccgtccatgagttatcgctttgtatgaagttaaatacagtcatgcgttgcttaacagcagggatacattctgagaaatgcattgttaggcaattccgttgtgcgaacatcctagtgtacttacacaaacctaggtggcatagcccacaacgtacccaggctatatggtaaacctgtacagcatgttactgtactgaatactgtaggcagttgtaacacaatggtatttgtgtatctagacatagaaaacatacagtaagaatatggtattataatcttacgggaccactgtcaaatacgcggtctgtctttgaaaagttgtaatgcggcgcatgactataaatacctagctggttagcatttacattccttgccagggagtttgaaatttatactatagaaataactttaggttttaggtagagttaaagaggtaaagcacatgttgccacaacccaggaaagtatttttaagaaagattggattttcctacctttagagatctaaaaaaaatttaatataaaaaatcattttgtgttggtgtttattactagttcagatgagtggctgctgaaggggcccccttgtcattttcattataacccaatttccacttatttgaactcttaagtcataaatgtataatgacttatgaattagcacagttaagttgacactagaaactgcccatttctgtattacactatcaaataggaaacattggaaagatggggaaaaaaatcttattttaaaatggcttagaaagttttcagattactttgaaaattctaaacttctttctgtttccaaaacttgaaaatatgtagatggactcatgcattaagactgttttcaaagctttcctcacatttttaaagtgtgattttccttttaatatacatatttattttctttaaagcagctatatcccaacccatgactttggagatatacctataaaaccaatataacagcagggttattgaagcagctttctcaaatgttgcttcagatgtgcaagttgcaaattttattgtatttgtagaatacaatttttgttttaaactgtatttcaatctatttctccaagatgcttttcatatagagtgaaatatcccaggataactgcttctgtgtcagtcgcatttgacgcataactgcacaaatgaacagtgtatactcttggttgtgcattaacttacatgtataatttttggcatctgtgttcacaaatgcatgtgttagcaaatcacctttatttataagtgacaataattgaagttaaggatataaagaaacctgcatttgtagtccagcgttttcatttggtccataacacaatgtatggaaatgtgaaagacaattttgtacatttgtttgttactaactcagatcattaaaatgaaaacaatttttttaaacaagaaaaaaaaaatg

SEQ ID NO: 426573 - DNA, 300 bp, Homo sapiens
tctattttattttagtttaacaagatttcagtgtgttaatgaagtttgtttataacattgcagaactgttcaagctaagccaagtagtagcagtaaaacttctgatcctctagcatcaaaaactacaactacaaaagccccttccgtgaaacccaaagttaaacagccaaaagtaaaggctgagccaccaccaaagaaacggaaaaaatggaaagaagaattttcatcatcccaatctgactcatctcctgagatccatactagtagtagtgacgatgagggtgagttttccgtgaaatg

SEQ ID NO: 426574 - DNA, 3609 bp, Homo sapiens
gaatcagtttgtttctcttggatcgatgtgtttcccagaggcagtgcttcttagtgatgaaagaaatattttatcaaatgtagatgatatcttagcagctacagcagcagcttgtggagttacacctactgatttttccaagtcaacttcaaatgaaaccatgcaggctgttgaagatggtgattctaaatctcattttcagcagtcattagatgtcaggcatgtgacttcagattttaactctatgacagctacagtaggaaagccacagaatataaatgatacttccttaaatggaaatcaggttactgtgaacctttcaccagtacctgcccttcagtcaaaaatgactcttgatcaacagcacattgaaacacctggtcaaaatataccaactaaagtaacttcagcagtggttggaccaagtcatgaagtccaggagcaaagttctggcccattcaagaaacagtctgctaccaatcttgaatctgaagaagacagtgaagctcctgttgatagtacattaaataataacagaaaccaagagtttgtttctagtagtagaagtataagtggagagagtgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcattttaaccttcaaaagaaaagagctaaaggaaaagggcaagttaaagaggaagacaacagtaatcagaaacagctgaaaagacctgcccaaggcaaacgccagaatccaaggggaacagatatttacttaccgtatactcctccttcctcagaaagctgccatgatggttatcagcatcaagaaaaaatgagacagaagatcaaagaggtggaggaaaaacaaccagaagtcaaaacaggatttattgcttctttcttagattttctgaaatccgggcccaagcagcagttttccactcttgctgtacgaatgcctaacaggactagacggccagggacccagatggttcgtacattttgtcccccaccacttcccaagccttcatctacaacacccacacctttagtgtctgaaactggcggtaacagtccatcagataaagttgataatgaacttaaaaacttggaacatttatcttcattttcttctgatgaagatgatcctggatatagtcaagatgcttataaaagcgtctctactcccttaactactttggatgctacttctgataaaaagaagaaaacagaagccctacaggtggcaactactagcccaactgccaatactactggtactgctactacttcctcaaccactgtgggtgcagttaagcaagaacctctccactctacttcatatgcagtaaatattctggaaaatataagctcttcagaatcctcaaagcccattgaacttgatggtcttccttcagaccagtttgcaaaaggacaggacactgttgccatagaaggttttacagatgaggaggacacagaaagcggaggagaaggccaatacagagagcgtgatgaatttgtggtaaagatagaagacatagagacttttaaggaggctttaaaaacaggaaaagaacctccagctatttggaaagtacaaaaagctttattacagaaatttgttcctgaaattcgagatggtcaaagagaatttgctgctacaaatagttatcttggatattttggagatgcaaagagtaaatacaaaagaatatatgtgaagttcattgaaaatgcaaacaagaaggaatatgtcagagtgtgttctaaaaagccaagaaataaaccttcacaaactatcagaactgttcaagctaagccaagtagtagcagtaaaacttctgatcctctagcatcaaaaactacaactacaaaagccccttccgtgaaacccaaagttaaacagccaaaagtaaaggctgagccaccaccaaagaaacggaaaaaatggaaagaagaattttcatcatcccaatctgactcatctcctgagatccatactagtagtagtgacgatgaggaatttgaacctcccgctccctttgtcactcgctttttgaacacaagagcaatgaaggaaacctttaagagctacatggaattgcttgttagcattgccttggaccctgacacaatgcaagccttagagaagagcaatgatgagctacttttacctcatatgaaaaaaatagatggcatgctaaatgataaccgaaagagacttcttttgaatcttcatttggatcaatcattcaagaatgctttggaaagttttcctgaactaacaataattactcgagattctaaagcaaagagtggaggaactgctatttctaaaatcaaaatgaatggcaaagcctataataagaaaactctaaggacttctaaaacaaccaccaaatctgcacaagagtttgctgtcgatccagagaaaatacagttgtattctttgtatcattcactccatcattataagtaccatgtttatctgatatgtaaggatgagatttcttcggtgcagaaaaaaaatgaagatttaggacaggaggaaattgttcaactttgtatgaaaaatgtaaaatgggtggaggacctctttgaaaaatttggagaacttctaaatcatgtacagcagaaatgttcctgacttttccacaaaaatcccatctttttatagcactaatgaaatggcagatatggggtggtcaaagataatcagatgtcaagtagtggccttctgcaggccggccgcttccatcatggaactgtcattaccacctctgctgaaggacagtggtgcggcctttaggaacgaagttagtcctctggaaatggacctaaatcccaccacatttttaccctaatgaatgatttttctattttgtaaaccattgggtaacttgagtcatattttcagaaacattttttgacaaatgatgaagcatgcactaagtataatttttttttattgctagagaagtaacacttaaagtaacgattttttttttctgactccggctaaacaccagaatgacagagaagtggcagaaaccatatgtttgtactcacatctggccacaaaaccagaaatactgtacattatgtaaagaggtctggtgtggtgtgacatcctgtataagaatatcatcaatttaaaatataaaatttggaaactattctgctttacagactccttttactcttaacatgttcaggaaactggatgtggaattggtgcaattctctgactgctttttgtgtcaaattatattgtgataaaaaaacaatgacatactattttccctatcgcaaagaaaagtattttcgtttatactgttttttcctttggaaaattttcaattgtacattttatttcactgatagttgtatttttcacaaggaaaatgttgtggttataattacgtttgatatatctctacaacaccttttgttattttcagtaaatcttacctcaagatagaattcacattagaaattcaacatataactaaggtcgac

SEQ ID NO: 426575 - DNA, 3694 bp, Homo sapiens
gagacctgcctgcctcagccacctaaagtgctgggattacaggcgtgagccaccgtgcctggcctagacttcacttttaattagtagtgactagccaggcatttccaaatgatttgatttccaaaattttgaattattttgtattttaaggtaattagctgtatacttggatatttttcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggataatatagttggatcaaacaaaaacaacacaatttgtcccggtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataa

SEQ ID NO: 426576 - DNA, 1644 bp, Homo sapiens
aggaagtctcggccaaagtactcccgccccagtcgggtacccctcctcgcgagagcgccgagcattccggcctgggaagcgcgtgcagaagcggaggtgctgctcatgggacttgtcggccgccgtagcccctgctaggacagcccgtgcgagcctgctggaggaggaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggtaaggttatcggaactgtagaataggggatagtgcctctggttggggcacagcttgggtttagggccctgggcccgttaccgttgctactccttcgggacagcgcgttggttctgaactggctcttgtgtacggcaaaaacaaagtactgtacttttgactggacttatcctcggagaccgagactctctgtccttctcccatctctcttaaggattggactccttcctttccagtccctcctcttttgaagaggggagagtgtgagagagaagggaggaagtagtgagagactaggtactgatgtcgccctaggagctgacaccttcctccccctttatttacttatccattatacgtctagtacaaacggtttagggaaacttttctttccgagtgtttttaaaaaaaaaaaattgtaccaacgggccccaggtgccacagtcgacaggtgctggggaaaaccgaaaggcacgttttcctggctgtattgctgactgttgccacgatacatggacacacaagcacatacatctgtagtctgcatttcttcgggctgcctttgtagaaggcgctatgagaaagtgaatgccttacaatctaagcaagttgggacaccaaagcaggttgtaaactgctgtgttctttggtttattgtagtcatgtgaagtattttaaattacaaaatgtagagccgtaattaaaatgccttttatagtataatctggacttgatttgaacaactgatataggcagttagaaaaataatcttaggtttagtcttgacatattttgtattcttgcttgttcccttttattttaaatagtcatcacttctacagaaggtgttcttttgttcttaatgaggaaaggataaatgcagcactgtaatttctatactaagtatttaatccctgtcatgatgtttttgttttgtaatttgcattatttgttaaactgggaatgcaataaaacaacttttgttaaaacgaatggctt

SEQ ID NO: 426577 - DNA, 560 bp, Homo sapiens
ttttcaagttttctgtgcagtcctgactcatgtgtaaagaaaccaggacattacattttggaaggtgattttgaaaaaccttttttgatcagctttagaactacaaaacaaaattttaaagtttttcttctaacaagcattgtattatattttaaatgtaaattttgtgcttatacaggaagatatcaagtctcttactgcccatatagttgaaaacttttataaagcacttgaatcgattgaatatgttcagacattcaaaggattgaagactaaatatgagcaagaaaaagacagacaaaatcagaaactgaacaggtattgtttaagtatactgcttttatagcctacaaaactgtgtccaaaattgtttgtagttcagattttccatgtgaaatttactgaggaattttctttccatcactggatagcatagagttgaataggagggtaaggcgtcccccctaccccatatcatttatatgttgaattactactccatgttgtaacttacgaagaatatttagtttaatttacaacatcctaaaatattttggagt

SEQ ID NO: 426578 - DNA, 716 bp, Homo sapiens
cctcttgatttctatttgtactttgtagatacctcttttctagtgtgatgatatggaaatatttatttttaaacaggatacattaattgtttggtcagaagcagagaactatgatttggctctgagttttcaggagaaagctggctgtgatgagatctgggaaaaaatttgtcaggtaagtttctttttataatatttaacttaatgtttgcttcttttctggaatttttgtttcctttttacttcaaacatattaggatgtggcgagatagtgtcttaatgtgagacttgataatctaacttgaaattttttatattctacggcaaattattttactttaagttttttaaaaacaactttgtcatacttttgttttaccactttagattttgatagcatatgctcataattaataccttatattgtaaaatggcaagtactttaagcaaaccaaaagaagattaagtaattaaatcaagcttttagattaaaaacataaatatttggtcatatgtttgcctaatgtttatgcatactgtaccaggcactaatgctcaacagtattcatgacttcagtttatgtggaacttagagtgtagcaggatatatagaatatgtggtaactcttaagtaactagaatttttttaaaagaaaccttttgttttaggacagttttagatttacagaaaatataactataatgcagaagacaaa

SEQ ID NO: 426579 - DNA, 355 bp, Homo sapiens
gagacctgcctgcctcagccacctaaagtgctgggattacaggcgtgagccaccgtgcctggcctagacttcacttttaattagtagtgactagccaggcatttccaaatgatttgatttccaaaattttgaattattttgtattttaaggtaattagctgtatacttggatatttttcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagaataaaagacgtaagagtagaaagaaaattctcttcaaa

SEQ ID NO: 426580 - DNA, 4492 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggatttttttttaaaacattacagatatagttggagtttcgtatgtaccccttcacattcccattcccattctaccccctcttcctccatctctcaagataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataa

SEQ ID NO: 426581 - DNA, 4471 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggatttttttttaaaacattacagatatagttggagtttcgtatgtaccccttcacattcccattcccattctaccccctcttcctccatctctcaagataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataa

SEQ ID NO: 426582 - DNA, 4396 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataa

SEQ ID NO: 426583 - DNA, 4482 bp, Homo sapiens
tctaggtaacattatggcggatctgtagtacttaacgtaagtgaagatagatcaatacgatgctcctgcgtagggacataccatgatcgatagacttgggtgtgttgtgactgcctgcatgcaagtagaaaagagtgacaccggggggcgctacacgcggacgcggattacgtgcacatcaagattgcgcatcattggtacgatcctcgtatgcgttcgactgtgactggagaatcttatgcgaagcacgataggtgcaattcgaggctctcatcactcaagactctgacgccgcgcgccctgcgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggatttttttttaaaacattacagatatagttggagtttcgtatgtaccccttcacattcccattcccattctaccccctcttcctccatctctcaagataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataa

SEQ ID NO: 426584 - DNA, 3772 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataa

SEQ ID NO: 426585 - DNA, 3573 bp, Homo sapiens
aggttgttgtattttatgagttattgtattttaaatagctttgtaactttatctactgtcggaattcagcctcctttactgttttccttgttccttgtcttacaattcttcttgtttttctaatctgttataaactgacaataagatccttaggcttgtttgaattatgtttaaattaagagtaagtagaccctgaaagggggctagagaatctaagttaagtgagttttcacgtaacacctctagaacaaatatttttgttttccagagagttatttgtagttgaggtttttagttaaactagatattgatgtatttataacaagaattgaatggtgtagtcaaattttagaaaattgtaacacagaaatacaccccagaatattaggtttcatgatgaaaatactacttgtcaactattttttataatttgtgtaagtcatataaatgagtataactttattcttttgttaatatttcatagtaattatttttctcatgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataa

SEQ ID NO: 426586 - DNA, 4237 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggataatatagttggatcaaacaaaaacaacacaatttgtcccggtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataa

SEQ ID NO: 426587 - DNA, 5554 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggatttttttttaaaacattacagatatagttggagtttcgtatgtaccccttcacattcccattcccattctaccccctcttcctccatctctcaagataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataattgatgtttgtgtttggtttgttgtaaatataaattaactccattttgagatatgtcaattttacagtatcttttaaaagccaataaaattatccataaatatttattataaactgctagatcataccccaattttaatgaaataattctaaacaaatgcgggtcaatggcactttatcagtgactacttatagaaggtaagccttggggaaatcatagcatcacagtatggagcttttctcaccttttcaattaaaggtgtacatatagtaagaaagaaagaccttccacctcataaggcaggtgactcaggatattttaaactaagatcagtaaagttcccatccactttctttgaatcatcaaattttatcgagacccatctctcagcttttagtaaatttcttcttaaaataagcccacatgtaaaacactttcctagttactttttgtttgtttgtttgagtctcgctctgttgcccaggctggagtgtagttgcacgatttcggcttattgcaacatccgccacctgggttcaagcaattctctgcctcagcctgagtagctgggattacaggtgcccgtcaccatgccaggctaatttttgtattttcagtagagacggggtttcaccatcttggccaggctggtcttaaactcctgacctcacaatccacccgcctcagcctccctatctctgtatcttatgaagacttcctttttctttctgaagagctgccataagtcttaaacatttaaatcatcagaaccttttcttgtagcagaaatgtgaatgttttcttgaagtacaggttacggttttcatggtacaagtgcttacctacgacgataagagaacaaggcttaaaatatccctcaaaagaacaattgtgagaattccatgttagcggctgtctttaaacgactaccctcaggcagatctgggtttttatatctttatcttcattcagtgaagcaagccaaaagcccacatttgtatgccttaggtcttcttaaaatggtatctgtaaacatgtgtccaatataaaaactatttttaataaaaagttacatgaaacaga

SEQ ID NO: 426588 - DNA, 2153 bp, Homo sapiens
  misc_feature (52)..(52): n is a, c, g, or t
tatgttcagacatcaaaggatttgtctgtctttttcttgctcatatttagtncttccaatcctttgaatgtctgaacatattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataa

SEQ ID NO: 426589 - DNA, 5501 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggatttttttttaaaacattacagatatagttggagtttcgtatgtaccccttcacattcccattcccattctaccccctcttcctccatctctcaagataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataattgatgtttgtgtttggtttgttgtaaatataaattaactccattttgagatatgtcaattttacagtatcttttaaaagccaataaaattatccataaatatttattataaactgctagatcataccccaattttaatgaaataattctaaacaaatgcgggtcaatggcactttatcagtgactacttatagaaggtaagccttggggaaatcatagcatcacagtatggagcttttctcaccttttcaattaaaggtgtacatatagtaagaaagaaagaccttccacctcataaggcaggtgactcaggatattttaaactaagatcagtaaagttcccatccactttctttgaatcatcaaattttatcgagacccatctctcagcttttagtaaatttcttcttaaaataagcccacatgtaaaacactttcctagttactttttgtttgtttgtttgagtctcgctctgttgcccaggctggagtgtagttgcacgatttcggcttattgcaacatccgccacctgggttcaagcaattctctgcctcagcctgagtagctgggattacaggtgcccgtcaccatgccaggctaatttttgtattttcagtagagacggggtttcaccatcttggccaggctggtcttaaactcctgacctcacaatccacccgcctcagcctccctatctctgtatcttatgaagacttcctttttctttctgaagagctgccataagtcttaaacatttaaatcatcagaaccttttcttgtagcagaaatgtgaatgttttcttgaagtacaggttacggttttcatggtacaagtgcttacctacgacgataagagaacaaggcttaaaatatccctcaaaagaacaattgtgagaattccatgttagcggctgtctttaaacgactaccctcaggcagatctgggtttttatatctttatcttcattcagtgaagcaagccaaaagcccacatttgtatgccttaggtcttcttaaaatggtatctgtaaacatgtgtccaatataaaaactatttttaataaaaagttacatgaaacaga

SEQ ID NO: 426590 - DNA, 4615 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggatttttttttaaaacattacagatatagttggagtttcgtatgtaccccttcacattcccattcccattctaccccctcttcctccatctctcaagataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataaaaaaaaaacggggggcgcaaaagtatcccgagggccacttaccgttaccgctcctgtcaacgcggccctagggggcggattaaaccaagccggccgcctcacacccggctgcgacgccccgggcttggacgacccccggggcag

SEQ ID NO: 426591 - DNA, 3359 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagatagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagtt

SEQ ID NO: 426592 - DNA, 1524 bp, Homo sapiens
cctttttttttccccccccataaaaaaaaaaaaaaaaaaaaaaaaataaaaaaaaaaaaaaaaaaaaaaaaaaaaaaaaaaaaaaaaaaaaaaaaaaaaaaaaaaaaaaaaaaaaaaaaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataattgatgtttgtgtttggtttgttgtaaatataaattaactccattttgagatatgtcaattttacagtatcttttaaaagccaataaaattatccataaatatttattataaactgctagatcataccccaattttaatgaaataattctaaacaaatgcgggtcaatggcactttatcagtgactacttatagaaggtaagccttggggaaatcatagcatcacagtatggagcttttctcaccttttcaattaaaggtgtacatatagtaagaaagaaagaccttccacctcataaggcaggtgactcaggatattttaaactaagatcagtaaagttcccatccactttctttgaatcatcaaattttatcgagacccatctctcagcttttagtaaatttcttcttaaaataagcccacatgtaaaacactttcctagttactttttgtttgtttgtttgagtctcgctctgttgcccaggctggagtgtagttgcacgatttcggcttattgcaacatccgccacctgggttcaagcaattctctgcctcagcctgagtagctgggattacaggtgcccgtcaccatgccaggctaatttttgtattttcagtagagacggggtttcaccatcttggccaggctggtcttaaactcctgacctcacaatccacccgcctcagcctccctatctctgtatcttatgaagacttcctttttctttctgaagagctgccataagtcttaaacatttaaatcatcagaaccttttcttgtagcagaaatgtgaatgttttcttgaagtacaggttacggttttcatggtacaagtgcttacctacgacgataagagaacaaggcttaaaatatccctcaaaagaacaattgtgagaattccatgttagcggctgtctttaaacgactaccctcaggcagatctgggtttttatatctttatcttcattcagtgaagcaagccaaaagcccacatttgtatgccttaggtcttcttaaaatggtatctgtaaacatgtgtccaatataaaaactatttttaataaaaagttacatgaaacaga

SEQ ID NO: 426593 - DNA, 2659 bp, Homo sapiens
  misc_feature (2649)..(2649): n is a, c, g, or t
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggatttttttttaaaacattacagatatagttggagtttcgtatgtaccccttcacattcccattcccattctaccccctcttcctccatctctcaagataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaatcgatcttctggcttaggtttttccactggtgccacaactgcttttccttccctctacctgcacngacaacacat

SEQ ID NO: 426594 - DNA, 2258 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtaagtataaaatgttttaaggagcaacatttttaatagagataaaactgaagttacccatttgaagttatttattagcagtgtatattctatgaatgagatgattgtgagaagtcctattcttttgttcttatttaaagggcaagaggactaggttgtagtgattttcccacccacatattg

SEQ ID NO: 426595 - DNA, 1020 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggcaagtagttgtttatctttaatttgaaagacttcatctgtgatcaaggaagtattaatctgacaaaggtgggaaagctttcctgacaagaaaaaaacatgtttggtaaacaaagatcatgtgtatttctcttgcaggttaaaagtttcagactgaaaaaaagtttttgtactggtgataattatcatttttggattgagccactgtcggtttattctaagatgtatttattagtattatttaactgtagttagccaagtctcttctataccttgtacatgaaaccttttattctgagtcacgtttaaaggaaatgacatagaacaaaattcaaagggatactcttaaagcaaggaaagcctgtttgtggtgtgaaattaaatcctttgactcaagtaaaggtagaggttttgaag

SEQ ID NO: 426596 - DNA, 1244 bp, Homo sapiens
gtgaaaagtatatggggtggtggttgtaggtaaaatttaatagtagtaggaagctgaataatatatgaagaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggtaagtttctttttataatatttaacttaatgtttgcttcttttctggaatttttgtttcctttttacttcaaacatattaggatgtggcgagatagtgtcttaatgtgagacttgataatctaacttgaaattttttatattctacggcaaattattttactttaagttttttaaaaacaactttgtcatacttttgttttaccactttagattttgatagcatatgctcataattaataccttatattgtaaaatggcaagtactttaagcaaaccaaaagaagattaagtaattaaatcaagcttttagattaaaaacataaatatttggtcatatgtttgcctaatgtttatgcatactgtaccaggcactaatgctcaacagtattcatgacttcagtttatgtggaacttagagtgtagcaggatatatagaatatgtggtaactcttaagtaactagaatttttttaaaagaaaccttttgttttaggacagttttagatttacagaaaatataactataatgcagaagacaaa

SEQ ID NO: 426597 - DNA, 711 bp, Homo sapiens
ctttctttgttactttcttgggaaaaactcaatacactgcagagagagagagacaaatgggatcaatagtgattatggtgcttgctgttctgacttacatgttgtttattttgtgtctgttttacctcaagtatttatttgtgttgagaacacttaaaatctactgtcttagcagtttgcaagtgtaatacattgttagtaatatgttgttattatatatgttgtacaatagattggttcttcactgcgtttcatattcgtatcacaggcatctttttaaaaaattattttgaataattttcctcagaaaaacattttgtgatgctctctgatctttatcttgccttcatttttacttagtacataatatgaagtagacttaattttcagttccacagaaataagattaaagtgaatatagttagtttttggttctttgacaacgtataaccaagtgtttgatttttttcacagtattttaaagtatctgcttatatatgatctgtactgctaattctttttgttttggtttggttctggaaaaggtatgtactgctaatcttgaagatgtttttatttacataagtaacagtattgtttaaaaaattctatgtttcagaaaaccgaaaaaagtgaatttctaaattttttctacaaccattgtatgcatgttctcacagcaccacttttgaccaatacttcagaagacaa

SEQ ID NO: 426598 - DNA, 283 bp, Homo sapiens
tattctttatttagatatattcaatatttattttcatgagattactttcttttgtagataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtaagtataaaatgttttaaggagcaacatttttaatagagataaaactgaagttacccatttgaag

SEQ ID NO: 426599 - DNA, 1819 bp, Homo sapiens
tcggtgcgacgcaagtctcagctcagcgcgcttatcctgggtccaccggcgctaccgccccccgacgtgagagagcgaagttcttgggccgcgctccctccctacctgggtgccctccccctccgggagcctgggtccccggggcggtcgcggcggctgcatcctcaggccaggccgcggggggagggggcggcacgggcctccgaaagcggggccatggagcccagagagtcggggaaggtaggactggaaggcccgggggccgcccgctccctcccgaggatccccgagccgggctcgggcgaggcggggcggctcgggcggaggccccgcagatgagccaggcttgcagggaaggactcgccggcccgccctctcttcccgcacttcggcgcccgaccccgggagggtggcggagaggagcggacgcttccgttcggtgtccgcgcatcctccccgagctgccgagcgtccgctgggtcgatgctgggttgggtgacccccgagtggagcgatgcgaaggtgcttcctgttttccccaccaccttcggcgttttgaagaggccctgctaaggcttggagtctggatcggacgccagtgggagctgcagggtgggacgcttgagggcttgaccctgcctagatcctccttaccaagaaagggctgaaaagagagggcatctggcatgctttttgccacttctgtttctaggttatgtacttcatggaatatctgggcattgcttagaaacctgtgtcataaattggctttgggcaagaggctttgagttggaagaaaaggtggaaagaaagtgcttgggggcggagttcagggatttgacgggattgccagcgcttccaggccgtgtcatccaagaccagtgtggttgtgggcacattagcttggagacagtggcagcctcttgggactaacatctttctggatgttgtttgctgccagttcttgagtattgtttcttatttggcacagaggagaattctctcaacaaacgttttcgactgtttattgagtcccttaaaaaactgtccatttaataaacatttgtgatctgtgatttgcattgaacgagatgctggaagtatgaggataaataggaaatgatcacctttctcaaggagctctcctgcagttttcacttcaataacttggacacgcctgaaagggttgtcccacacgaaaagagagaaaaggataatgaggttcttttgatgctgtagtttttcctgggaagactaggaaggactctgaatttcaaaagaggtgatttctcgcatgagcatctcttccatcctccctccctccacaagctacagtgatgcatgtagcagacacggcacctacagagtacgtggtccaagccaataaagctcaacaaaacccaagcaaagatggagcttatggcccttaccctttggaaatatccccagattggtttagattgaacctgaatttgaataaagagaagcaaaatgtagggggaagaaggattataaaatattgggattgatattggtatcagtgatttgaagttgatttccaagctattctgttcagtcagaggctttcttagcctttaacgggagaagagaaatacggtcatgcgctgtataacaaggtttccatcaacaccgctctcacgtacaatcccctgagactacagtggggctgagaaattcctatcacctggtgacatcttcatgatcctgaccctgtgtaggcttaggctaatgtgtgtgtttgtgtcttaggttttaagaaagcttaaaaagttgttaccattctgatttggagcggccg

SEQ ID NO: 426600 - DNA, 2479 bp, Homo sapiens
gctaaaggaaaccaacagcggcctaggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgggacaagacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgccaaatcaatcattcaggagtttccagagatcacaattttaactactgaagttcatcctgttgcacctacacattttggacagaaatactttggaacagactaagttatttaagtaaaataattgtcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcaattggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaacatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtgttggctagctgattacttgattaattatactcccatggccccataggaagctgttgtgggcctctgttcaaaagcacagaaaagagcagaaggaaatgtcttagaaagaatcaaagctgatgaaatcagcaaagattgggggaaaggaaggaagcctggtgtagattggattatatttttcctttggggactagaatactagaagaacttcagtatatttttccctttatttttgaatactgtcatataataaattgagattaataaattactcatattacagttcttccatggcaa

SEQ ID NO: 426601 - DNA, 704 bp, Homo sapiens
actcccaggttaccgtgagacgaccttgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaacatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtgttggctagctgattacttgattaattatactcccatggccccataggaagctgttgtgggcctctgttcaaaagcacagaaaagagcagaaggaaatgtcttagaaagaatcaaagctgatgaaatcagcaaagattgggggaaaggaaggaagcctggtgtagattggattatatttttcctttggggactagaatactagaagaacttcagtatatttttccctttatttttgaatactgtcatataataaattgagattaataaattactcatattacagttcttccatggcaa

SEQ ID NO: 426602 - DNA, 2537 bp, Homo sapiens
gctaaaggaaaccaacagcggcctaggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgggacaagacagccagtagaggtgacttcatgttttctgcggatcgtttggttttgcctgaggatttattccaaaagagcatagacaactcctgttctgcttttcatcatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgccaaatcaatcattcaggagtttccagagatcacaattttaactactgaagttcatcctgttgcacctacacattttggacagaaatactttggaacagactaagttatttaagtaaaataattgtcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcaattggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaacatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtgttggctagctgattacttgattaattatactcccatggccccataggaagctgttgtgggcctctgttcaaaagcacagaaaagagcagaaggaaatgtcttagaaagaatcaaagctgatgaaatcagcaaagattgggggaaaggaaggaagcctggtgtagattggattatatttttcctttggggactagaatactagaagaacttcagtatatttttccctttatttttgaatactgtcatataataaattgagattaataaattactcatattacagttcttccatggcaa

SEQ ID NO: 426603 - DNA, 1984 bp, Homo sapiens
agtaaaagggctaagagacagtgttcttggccttggcaaactttggagattggggacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgccaaatcaatcattcaggagtttccagagatcacaattttaactactgaagttcatcctgttgcacctacacattttggacagaaatactttggaacagactaagttatttaagtaaaataattgtcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcaattggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaacatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtgttggctagctgattacttgattaattatactcccatggccccataggaagctgttgtgggcctctgttcaaaagcacagaaaagagcagaaggaaatgtcttagaaagaatcaaagctgatgaaatcagcaaagattgggggaaaggaaggaagcctggtgtagattggattatatttttcctttggggactagaatactagaagaacttcagtatatttttccctttatttttgaatactgtcatataataaattgagattaataaattactcatattacagttcttccatggcaa

SEQ ID NO: 426604 - DNA, 1805 bp, Homo sapiens
aaattaaacaaaataaaaaatactctttagggggaaagtttctataactgaacaattatatttttcaacttgagtataaaataataattctaagaatgtattagtgagatggagggggcataatctgactactgtcaaagcttttcagactttatacaaaggaagagattaaccaagtctgattaggtatccaaagatcattgctctctgtcttctctcaattttagacctagtggcaataactacaaaattcctgaattacaactggtgttaccaaaacatcctaccataataacttttgtttttttgaaggtgccaaatcaatcattcaggagtttccagagatcacaattttaactactgaagttcatcctgttgcacctacacattttggacagaaatactttggaacagactaagttatttaagtaaaataattgtcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcaattggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaacatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtgttggctagctgattacttgattaattatactcccatggccccataggaagctgttgtgggcctctgttcaaaagcacagaaaagagcagaaggaaatgtcttagaaagaatcaaagctgatgaaatcagcaaagattgggggaaaggaaggaagcctggtgtagattggattatatttttcctttggggactagaatactagaagaacttcagtatatttttccctttatttttgaatactgtcatataataaattgagattaataaattactcatattacagttcttccatggcaa

SEQ ID NO: 426605 - DNA, 2529 bp, Homo sapiens
gctaaaggaaaccaacagcggcctaggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgggacaagacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgagttcagcatgaggcagtaactagggctccatatagtcctgaggtgggtgccaaatcaatcattcaggagtttccagagatcacaattttaactactgaagttcatcctgttgcacctacacattttggacagaaatactttggaacagactaagttatttaagtaaaataattgtcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcaattggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaacatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtgttggctagctgattacttgattaattatactcccatggccccataggaagctgttgtgggcctctgttcaaaagcacagaaaagagcagaaggaaatgtcttagaaagaatcaaagctgatgaaatcagcaaagattgggggaaaggaaggaagcctggtgtagattggattatatttttcctttggggactagaatactagaagaacttcagtatatttttccctttatttttgaatactgtcatataataaattgagattaataaattactcatattacagttcttccatggcaa

SEQ ID NO: 426606 - DNA, 2409 bp, Homo sapiens
gctaaaggaaaccaacagcggcctaggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgggacaagacagccagtagaggtgacttcatgttttctgcggatcgtttgggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgccaaatcaatcattcaggagtttccagagatcacaattttaactactgaagttcatcctgttgcacctacacattttggacagaaatactttggaacagactaagttatttaagtaaaataattgtcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcaattggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaacatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtgttggctagctgattacttgattaattatactcccatggccccataggaagctgttgtgggcctctgttcaaaagcacagaaaagagcagaaggaaatgtcttagaaagaatcaaagctgatgaaatcagcaaagattgggggaaaggaaggaagcctggtgtagattggattatatttttcctttggggactagaatactagaagaacttcagtatatttttccctttatttttgaatactgtcatataataaattgagattaataaattactcatattacagttcttccatggcaa

SEQ ID NO: 426607 - DNA, 453 bp, Homo sapiens
  misc_feature (79)..(79): n is a, c, g, or t
  misc_feature (100)..(100): n is a, c, g, or t
  misc_feature (116)..(116): n is a, c, g, or t
gcaaattcttgtgtgtgtttgcataggaaggtagatgccatctactaaaagaggggggtttgaagggccccttcaaaanaataaccagaaaattctcttntgtgtggggggggggnggtgtttttaaaaaaactcaacctatctggtgttttattttaatggataaaaatgtaatttttctaaggtagcaacttatttccaaattaatatagatgaaaaatagataccaattagactaaattgaaagctttttgttctatatttgcatagcctttgaaatatttcttagtgcctaggaggtctggggattcctctttcgtggtggtcactaaccttacttgatgcagataaaatcacttgtcaatgcaaaatgtgttagaacttgataaagctttgagtttgagaaataaaggtatatttaaaatttaaaaaaacttgtcatttatgctcatt

SEQ ID NO: 426608 - DNA, 3208 bp, Homo sapiens
aactgagtgacctgtggaactgctttagaatctaacctgctgtcttcgtgctctgtgtgaaggggaagctggggggttagcatgaagtctggccttgtgtgcattggagcttccaaggcactttgaaatcattccagtatatttgggaagaattgagtgaatgagaatgctcttccttattctggtagatttgacttgtttataattctgcactttagaagaaaaacagtgttaatctgtagttgaaagaaagcttagtagatgagagagttctaggctactgtggctttttccagtagatttagatgagattatgtgttttgaaatgttttgtgggatcccttagaaagcatcacttcagggcagagacactcaatattgccagccagcttgggttctaaagtgatttaatcaaattcatgctcctgatcttttttttcccccttcctttggctatgaaaacccaaagcccggagtgattgttttctccttgctttaagcagtgaagttatcctaatgcaaaagagcttagtagaaaatgagtggtttacctttttttctaaaagtatattttcaagtttattctggaatgtgatgtcttggtcctcttaaaagcagatcagccatgactgaaactcaaggcttagctggtatctatgttgtgctacattaggtgactagaagccacttcttagtgtaatcagctcctgtttccctgtgagccttagttatattttaattcagtggctttgagtcaaggccggttctaattgaggggacccagtgtgcttcagtgttaagagtggggcaatgaagagtgaaccccaatgaagagtgatcccaactttggaaactatctggtcattcatgaccttaaaaagctgccatggtggtcaaatggcatgtgtttgcacaaaaatgaccgatgtgtttaaccaaagctttgaaatgtgatgaagccaccaacataagcacttgcctaacagaaatcagtatttcttctacttagaaggcttggggcccagggtaatgaggcaccagatgaagataagatctgcatcaaggaattaaatttccagtttgtccttggggttctttctgcttatgttttttcccccccatctggtaatagtcctcttctgagaatgaaaggggcacagaaattgcgagaaagacccagtccccagtctttgccaccattgcaccatggttgtctcggtgtcccttcacctgacctttttagtcagctcagatctttttgtagtttgagaatagacctattcaagagctatcagggttaaaagctgcactgaccaaagctgtacttttaaaacacaacccctgggctagtgatgtctctacttgctctatgagccttttgccagcctcagaataggcgaggtaaccttgaatttcagggccctggaaactctagctgaaacctgcctttcctaatgctcacacaagcaccaggtaccctgagcttatactgagtccagtggttcctattttatgtgtgtgtgtatgtgtgtgtgttgagtaacatgaaacttggcagtagcagagagcactgaagttcacatgcaagttctaatctaaagttaagcagtctcttatttgtttcgggactctgatttgactctttttctgatgctttcggcatgtctgcagcctgttctcctagcctgctgcttggagtcaggttgagcatcagtgagatgaagacagtaccttttcctctcacattggcagaatagcacgcactagatgcctgaccttgagctctagtctcccctttaaatcttaccttggcagtaacacattattcctcattcaataatttcaatgctgaaactgaactctattactaatgccttccaatcagagttcctgatggggatgcctgtgggatggcccacacctgggggacctggcagatggggtgagttgggtaaggaagatgatgcttagttcctgatagatgctacagatgtagtttggcatttcagtttttgtccagtttgattttcactggggtttgagtcacagcaagctgtgtatgaacttgtgttttgtggtgacacattaataatcaaattgctaaaaccctgaatctgcttattcttcagcttcacctctgcactaaccccttacccttatggtacgtcaggattttaactagtactgctttgttgactttgggaaatggtgccactcaaaagcaacttcctaacttgaggaataactcctttgtagtttactttctggtactggttggtgccttgtattgggatacagctatattcttagctcaaatgtcctctttttgagagcaaagtagttatccaatggtgagacgagaccctgacgctcatagaggccattccttcctgggtgtcggaccagggctctgtgtcagggaaaaccttctgggtggactttgtaagaatccagtttccaaggttagattcacatccttaatcttgcagagactagaatttcacagctcgctttggaacatattccaattcaaccagttaaaatcagaggaccaagtcgtgggggaggggggcggtgttgaggagaggtatttttaaagatctggcaacttttcaggattatttgtggagaactctaaggttaagatcaggaaataaaagactgtgtgtgtgtgtgtgtgtgcgtgtgtgtgttcaagtgcctaaatcttgtttacctatcactttaaaaaaataattgaagtgtaagctaaataaaatgcttggagttttgcctgggctagtgagagttggtgcaaattcttgtgtgtgtttgcataggaaggtgagatgaccatctactaaagaggaagtagctaaatacagatctgtgggtgtttttaaaaaaactcaacctatctggtgttttattttaatggataaaaatgtaatttttctaaggtagcaacttatttccaaattaatatagatgaaaaatagataccaattagactaaattgaaagctttttgttctatatttgcatagcctttgaaatatttcttagtgcctaggaggtctggggattcctctttcgtggtggtcactaaccttacttgatgcagataaaatcacttgtcaatgcaaaatgtgttagaacttgataaagctttgagtttgagaaataaaggtatatttaaaatttaaaaaaacttgtcatttatgctcatt

SEQ ID NO: 426609 - DNA, 2308 bp, Homo sapiens
ttcgtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggatttcgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcatatcccagaggtaatta

SEQ ID NO: 426610 - DNA, 631 bp, Homo sapiens
ttcgtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgtgagaaatatttatatcatgactatttttaatatggcatatatttggataagccttctagtaaaatgatctcaatattaa

SEQ ID NO: 426611 - DNA, 1960 bp, Homo sapiens
accccttgatgagcctttgatgaggagatgattaggagtaaaaaaatgctgcatagattatctgcataactaacactgtagcagacagccatgcagacatttttctgtatacaactcccactcatttttctgagagataaaagcagccaagattgacaatctgtcagtttcaccattttcattgtgtactttttctgggcaggttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggatttcgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcatatcccagaggtaatta

SEQ ID NO: 426612 - DNA, 898 bp, Homo sapiens
ttcgtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttctctgctctaggccctaggatgcagcagggaacaaaggagacaaaaatgcctgtccttggactgagcctgatttccagtgtgtccacgcggttgtcactctgcctccaccaggcccctttctctcctgttgcttgttttgtagcaaagagaagctaatagccagatatattttacaaaatcatgcctttcaaggcttctgtata

SEQ ID NO: 426613 - DNA, 427 bp, Homo sapiens
ttgacagcacagccctagactaagccgctttggaattcaagagggagtaagtgatgaggttccattgactgggtagtcttcaagtgtgcatggtgctaactctctgagcccaaagtgaatgagtggtcagtcaggttccaggcaggttatagggcaggatgcaacgccgggtaaggtcattctgcacatgttaattgttgatgtagaactctttcctgcgtgggtagggcccttgtacagcaaaagcagctgaagtttgtctttcagggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggatttcgattgc

SEQ ID NO: 426614 - DNA, 469 bp, Homo sapiens
aaggcacggaactttaggacactgctgccattgggctttggagaccagccttgcctaatcaaccaaggagatctcttgtttcaggctgatttgggtggaagttgtatggccccagcccgcatgtttacatgctccaaaagaggatggccacacaactaatctctcctttgtcttttcccaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgt

SEQ ID NO: 426615 - DNA, 414 bp, Homo sapiens
tccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttca

SEQ ID NO: 426616 - DNA, 1527 bp, Homo sapiens
ttcgtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggatttcgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcatatcccagaggtaatta

SEQ ID NO: 426617 - DNA, 2090 bp, Homo sapiens
taaatccaaaatcttatctgagtctcaccaactcaaaagtctcaaatctcacattgaagccatctaaattaagtttgggagaggatctgtgtgtgatttctgggacataattccaactgtgcacttgtgaacctagaaaacaagttatctgttcccaagtatgatggcatgacaggcagacaataatagttacacacgttcctgttcaaaaagcagaaacagatggaaaaaggagccatcagcaccaatcaatttacaaaaccagcgaggcacccttctttaagtttcaaggcctgggagtaatcttcagctcactgctgttctctgggcttgttgactgtctcagagtcatctttactttttcacaaaaggtagcacacgtttgcagctgagtatcaacttatcagttgttcttcttttatattctctaaagctttctgttaaaaatggtggtgcttctgctgctataacgttgtcaagaaacttgtgggtcttttacatatgtcacagggatgcactcatttagataggaggctcctcacgtatctttcctggaaaatcctgtctctgtttttggctttttctgaaatagctgagaggatctatgattcacacccttaatatcttcaaagagtcttgtgtgtgacctgatattcagaccttttgatgtttctgaagtattagcaaaaggttatacagccatatcttcatcactttctctagagtaaaggctgtcctgacggtgaatcttagttttagtggcttttgccatttgaataggccgcgaatttcccaaatcatcaagtcctggtttctttatatttaacaggtcttccctcaatctacctctttccacattttactataatcagcaagaagacagcaggctgtaccttccacagcttgcttggaaatatcctcagctaaatattgaagtcatcacttaaaagttctgctttacacataacggcaggacacaactcagcttagcttttcgccactatgtaacaaggactcctttcctccacttctccagtaacatattcctcattttttaccaacagtctattcatgatgatttagatattctatggcaatcgaggtattctctattatgctcctttcttcaaggccgccctagcattaacattccatatttctactaacagtctgtttaaggcagtttagcttcttttctggcatgctcctcagaattcttccagcctccacctactgcccaattccagagccacttttctacttttaggtatttgttacagcagcacctcaagtacctagaaaactcttttatgcctgcttctctgccagatgacttgaatatggtactagatttggaattcacctttctccagggtcactgtttatttcaaagaggtgaatttacctgtgctagggttttcacactgggagtgctaccagaactaccacaggatgaaagtggtgagcccaccactgcagagaagttttctcagtgccgtaatatagaggaattctcaaaataagccctactccttttcacttactgaaaacaacttggataatgtgtaacagccagccccatttcaaaaagattaccaggggtaaaacaactttttcatgggtcaaaatcatcttccgaagaaaatgatttcttaaaagaattgaacattgtaaatcaaagggcattgtcctgttttggattaacaaaacaggaaaaataaccaatccttgtaaaattatttgaaattttcttgtttttatcagttgagtgcctatagatgcacatacaaaaacaactgccatttttgtatataatagtcttccaagatagagatttacattaggagagaattaaacatccaggagggatgaacagtatttcatgtgtgctatgtagtgttttgcttcattgagagtcattttcatgaattatttttactactgcagtcatcttaaatttataatcatctcaaaaaagatgtcacaatgaacagacaaccatctgtgaggtcagtcattttgcatgatgtatgtaatcaaaaagtttgaaatgtctgcttactaataaagaatgttttcactgaaactta

SEQ ID NO: 426618 - DNA, 2722 bp, Homo sapiens
taaatccaaaatcttatctgagtctcaccaactcaaaagtctcaaatctcacattgaagccatctaaattaagtttgggagaggatctgtgtgtgatttctgggacataattccaactgtgcacttgtgaacctagaaaacaagttatctgttcccaagtatgatggcatgacaggcagacaataatagttacacacgttcctgttcaaaaagcagaaacagatggaaaaaggagccatcagcaccaatcaatttacaaaaccagcgaggcacccttctttaagtttcaaggcctgggagtaatcttcagctcactgctgttctctgggcttgttgactgtctcagagtcatctttactttttcacaaaaggtagcacacgtttgcagctgagtatcaacttatcagttgttcttcttttatattctctaaagctttctgttaaaaatggtggtgcttctgctgctataacgttgtcaagaaacttgtgggtcttttacatatgtcacagggatgcactcatttagataggaggctcctcacgtatctttcctggaaaatcctgtctctgtttttggctttttctgaaatagctgagaggatctatgattcacacccttaatatcttcaaagagtcttgtgtgtgacctgatattcagaccttttgatgtttctgaagtattagcaaaaggttatacagccatatcttcatcactttctctagagtaaaggctgtcctgacggtgaatcttagttttagtggcttttgccatttgaataggccgcgaatttcccaaatcatcaagtcctggtttctttatatttaacaggtcttccctcaatctacctctttccacattttactataatcagcaagaagacagcaggctgtaccttccacagcttgcttggaaatatcctcagctaaatattgaagtcatcacttaaaagttctgctttacacataacggcaggacacaactcagcttagcttttcgccactatgtaacaaggactcctttcctccacttctccagtaacatattcctcattttttaccaacagtctattcatgatgatttagatattctatggcaatcgaggtattctctattatgctcctttcttcaaggccgccctagcattaacattccatatttctactaacagtctgtttaaggcagtttagcttcttttctggcatgctcctcagaattcttccagcctccacctactgcccaattccagagccacttttctacttttaggtatttgttacagcagcacctcaagtacctagaaaactcttttatgcctgcttctctgccagatgacttgaatatggtactagatttggaattcacctttctccagggtcactgtttatttcaaagaggtgaatttacctgtgctagggttttcacactgggagtgctaccagaactaccacaggatgaaagtggtgagcccaccactgcagagaagttttctcagtgccgtaatatagaggaattctcaaaataagccctactccttttcacttactgaaaacaacttggataatgtgtaacagccagccccatttcaaaaagattaccaggggtaaaacaactttttcatgggtcaaaatcatcttccgaagaaaatgatttcttaaaagaattgaacattgtaaatcaaagggcattgtcctgttttggattaacaaaacaggaaaaataaccaatccttgtaaaattatttgaaattttcttgtttttatcagttgagtgcctatagatgcacatacaaaaacaactgccatttttgtatataatagtcttccaagatagagatttacattaggagagaattaaacatccaggagggatgaacagtatttcatgtgtgctatgtagtgttttgcttcattgagagtcattttcatgaattatttttactactgcagtcatcttaaatttataatcatctcaaaaaagatgtcacaatgaacagacaaccatctgtgaggtcagtcattttgcatgatgtatgtaatcaaaaagtttgaaatgtctgcttactaataaagaatgttttcactgaaacttattggaaaggtttttcaaattttctttgatttgtagttttgagtcctgaatagattgttttaacatgaataacatttcctgtggtttaatttcccttggcgcacctttgtcagggacagggaaggaactggttgtagcatattatctgaatatcctgttactgtttctgtttttattctacccaaataaaaaggttcaggtgcttcttttttgccacaatggatttctgaaaaccttgtcacaactgtgaaaggaaagcaaatcttgggaccccagaatcactaagctaaagggaaaagtcaagctggaaactgcttagtgcaaacctgcctcccattcattctattcagttatctctgctcactgagataaaggcctgtctgattgcctcctttggaagggctcatcagaaactcaaaagaatgcaaccatttgtctcttacctacctgtgccctggaagtcctctcccacacttcgagttgtcctacctttccatattgatccaatgtccatcttacatatattgattgatgtcttatgtctccctaaaatgtataaaaccaagctgtgccccaaccaccttgggctcatgtcatcaggacgtcctgaggctgtgtcacacctgtgcatcc

SEQ ID NO: 426619 - DNA, 1679 bp, Homo sapiens
ctgcttctgataagggagacgtatgagctgagatctaggtcgagaagtgatgtatgattcttgagccctttaatctctacaaaggagtgtagtgatgagaccgtggacttagtgtggacgaggctggtggcatgtagctcgtacggtttaatcccggggtaatgcatggctatgtattcataaggagctctgacgaaatatgcgcgaatgatcctaggaacaggatcatcgtcgtgtactatttagtggggtatgtctgcacaaactataggagaggtagcgtggcccgagaaatctctcgcgcaaaaaaatctactcacaatcctctggagtgtactgtataatcctatatgagagcgacgagtcctctccacatcaactgttagcatctatgtgccagagtgtatgtggctatatctccagcgaaggtactcagagaggggagcgagctacgcttacccaaatgcttgcctgtgcgtgcatccttccatctgcgatagaagtattgtaaactctcttgacgtatcatagagaagttgcttgttgttacagataacggcaggacacaactcagcttagcttttcgccactatgtaacaaggactcctttcctccacttctccagtaacatattcctcattttttaccaacagtctattcatgatgatttagatattctatggcaatcgaggtattctctattatgctcctttcttcaaggccgccctagcattaacattccatatttctactaacagtctgtttaaggcagtttagcttcttttctggcatgctcctcagaattcttccagcctccacctactgcccaattccagagccacttttctacttttaggtatttgttacagcagcacctcaagtacctagaaaactcttttatgcctgcttctctgccagatgacttgaatatggtactagatttggaattcacctttctccagggtcactgtttatttcaaagaggtgaatttacctgtgctagggttttcacactgggagtgctaccagaactaccacaggatgaaagtggtgagcccaccactgcagagaagttttctcagtgccgtaatatagaggaattctcaaaataagccctactccttttcacttactgaaaacaacttggataatgtgtaacagccagccccatttcaaaaagattaccaggggtaaaacaactttttcatgggtcaaaatcatcttccgaagaaaatgatttcttaaaagaattgaacattgtaaatcaaagggcattgtcctgttttggattaacaaaacaggaaaaataaccaatccttgtaaaattatttgaaattttcttgtttttatcagttgagtgcctatagatgcacatacaaaaacaactgccatttttgtatataatagtcttccaagatagagatttacattaggagagaattaaacatccaggagggatgaacagtatttcatgtgtgctatgtagtgttttgcttcattgagagtcattttcatgaattatttttactactgcagtcatcttaaatttataatcatctcaaaaaagatgtcacaatgaacagacaaccatctgtgaggtcagtcattttgcatgatgtatgtaatcaaaaagtttgaaatgtctgcttactaataaagaatgttttcactgaaactta

SEQ ID NO: 426620 - DNA, 1042 bp, Homo sapiens
accctgggtaacagaatgagtgagactctgtctaaaaaaaacaaaagaggaagaagaaagaaacaacagactgacggtggtgctaacgtaatgactgattgactgtattacaaggcgcagatgctgacagtctaatcaggtctgacaggaagtgggccacaaattggacactacaaaaaagagtctctagtcttctgcttctggccaacaagaattaactgctcttggaatttccctcttcaagtacctagaaaactcttttatgcctgcttctctgccagatgacttgaatatggtactagatttggaattcacctttctccagggtcactgtttatttcaaagaggtgaatttacctgtgctagggttttcacactgggagtgctaccagaactaccacaggatgaaagtggtgagcccaccactgcagagaagttttctcagtgccgtaatatagaggaattctcaaaataagccctactccttttcacttactgaaaacaacttggataatgtgtaacagccagccccatttcaaaaagattaccaggggtaaaacaactttttcatgggtcaaaatcatcttccgaagaaaatgatttcttaaaagaattgaacattgtaaatcaaagggcattgtcctgttttggattaacaaaacaggaaaaataaccaatccttgtaaaattatttgaaattttcttgtttttatcagttgagtgcctatagatgcacatacaaaaacaactgccatttttgtatataatagtcttccaagatagagatttacattaggagagaattaaacatccaggagggatgaacagtatttcatgtgtgctatgtagtgttttgcttcattgagagtcattttcatgaattatttttactactgcagtcatcttaaatttataatcatctcaaaaaagatgtcacaatgaacagacaaccatctgtgaggtcagtcattttgcatgatgtatgtaatcaaaaagtttgaaatgtctgcttactaataaagaatgttttcactgaaactta

SEQ ID NO: 426621 - DNA, 3318 bp, Homo sapiens
ttttgtccacttcactccagtagccaatcttccggggcccattagttttgagctcaaggatccttaattaaattaatccccccccccccggccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctga

SEQ ID NO: 426622 - DNA, 3411 bp, Homo sapiens
ttttgtccacttcactccagtagccaatcttccggggcccattagttttgagctcaaggatccttaattaaattaatccccccccccccggccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcctccctgcacaagcagcactttcttttgccatagcaacatgtgcatcaataattctttagtctgtaatggtgtccaaaattgtgcatacccttgggatgaaaatcattgtaaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctga

SEQ ID NO: 426623 - DNA, 2396 bp, Homo sapiens
ttttgtccacttcactccagtagccaatcttccggggcccattagttttgagctcaaggatccttaattaaattaatccccccccccccggccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcctccctgcacaagcagcactttcttttgccatagcaacatgtgcatcaataattctttagtctgtaatggtgtccaaaattgtgcatacccttgggatgaaaatcattgtaaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttcttta

SEQ ID NO: 426624 - DNA, 2511 bp, Homo sapiens
  misc_feature (2402)..(2402): n is a, c, g, or t
ttttgtccacttcactccagtagccaatcttccggggcccattagttttgagctcaaggatccttaattaaattaatccccccccccccggccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcctccctgcacaagcagcactttcttttgccatagcaacatgtgcatcaataattctttagtctgtaatggtgtccaaaattgtgcatacccttgggatgaaaatcattgtaaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttaaaaaancaaacaacctcccaccaatcatggcggccgcttcgcccagcgactttaagacttggaagcttatgcatgcggcccgaattgggctaatggccatcgccctggcgcggtt

SEQ ID NO: 426625 - DNA, 3432 bp, Homo sapiens
ttttgtccacttcactccagtagccaatcttccggggcccattagttttgagctcaaggatccttaattaaattaatccccccccccccggccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcctccctgcacaagcagcactttcttttgccatagcaacatgtgcatcaataattctttagtctgtaatggtgtccaaaattgtgcatacccttgggatgaaaatcattgtaaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctga

SEQ ID NO: 426626 - DNA, 3580 bp, Homo sapiens
ttttgtccacttcactccagtagccaatcttccggggcccattagttttgagctcaaggatccttaattaaattaatccccccccccccggccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctgaccctttaatcatgttatttatgccaccaaggttgtggatcttaaggtatgtatggaaaggaactcatttatcaaattgtaagtaatacagacatgccatttaaaagaggtaaattcttgttttctatattttgttagtaaattctcaatgaaataagttgaagtttcactggatttcattaacttttaaatattacatatatgtgttttctcagattagtgaaaattgtgaccttaaatttaatacacatatactgcctcag

SEQ ID NO: 426627 - DNA, 3587 bp, Homo sapiens
ttttgtccacttcactccagtagccaatcttccggggcccattagttttgagctcaaggatccttaattaaattaatccccccccccccggccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcctccctgcacaagcagcactttcttttgccatagcaacatgtgcatcaataattctttagtctgtaatggtgtccaaaattgtgcatacccttgggatgaaaatcattgtaaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctgaccctttaatcatgttatttatgccaccaaggttgtggatcttaaggtatgtatggaaaggaactcatttatcaaattgtaagtaatacagacatgccatttaaaagaggtaaattcttgttttctatattttgttagtaaattctcaatgaaata

SEQ ID NO: 426628 - DNA, 1622 bp, Homo sapiens
ttttgtccacttcactccagtagccaatcttccggggcccattagttttgagctcaaggatccttaattaaattaatccccccccccccggccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcgtaagtaaataattcctatagtattgagatcttttacatatttttcactcattcacagtacactcagcatttacttttttaaaatatttattttaggatgtttttttttgttttactacagctctttttaatgcaagaatattatttaaatttaaaatattttaaattttatttaatttttagaggtggggtgttgatttgttgcacaggctggggcaggagaatggcgtgaacccgggaggcggagcttgcagtgagccaacattgcaccactgcactccagcctgggtgacagagtaagactccgtctcta

SEQ ID NO: 426629 - DNA, 5013 bp, Homo sapiens
ctcctgctcttctttccgcttggcctccaacagcctctgctgctcctcctgagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctggaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggtcagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaattttttttctaagaagctgtcctacaaagttgagctttgttagtttttcatgtgtaatatattataaatttatcttttgggatataataaatgctttcatatacctgcaaaattttaat

SEQ ID NO: 426630 - DNA, 320 bp, Homo sapiens
agtgcagtggtatgatattggctcactgcaacctctgcctcccgggtttaagcaattcttgtgcctcagctactccagaggctgagatggatcatctgagcctcaggaggttgaggctgcagtgagctgtgactgcgccactgcactccagtctgggacaacagagcaagaccctgtcttaaaaaaaaaaagaaaaaaaaattttttttctaagaagctgtcctacaaagttgagctttgttagtttttcatgtgtaatatattataaatttatcttttgggatataataaatgctttcatatacctgcaaaattttaat

SEQ ID NO: 426631 - DNA, 5423 bp, Homo sapiens
gagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctggaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggtcagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaattttttttctaagaagctgtcctacaaagttgagctttgttagtttttcatgtgtaatatattataaatttatcttttgggatataataaatgctttcatatacctgcaaaattttaat

SEQ ID NO: 426632 - DNA, 4013 bp, Homo sapiens
cactgactttagaaaataatttttaatcttaaaatcaagacacttagaaatttagatagcagatacattggaaaagcagggaggtaactgtcagtaaaattaattattaaaatggagattatgttttccccagggtctcccagcaagctaaatatatctagagtcgggtgggctgttttctgaattttgtggcagtcaaagctttcttcagtttaagaatttcaggcatgtggttcttgactgtagctgtgggactcatttagaacttcacgctttccttgggaggggatggggtgcggtgcaaatgcctgtttgtgcaaggctccgagcggctgaccttcccctggctgtgccgcaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggtcagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaattttttttctaagaagctgtcctacaaagttgagctttgttagtttttcatgtgtaatatattataaatttatcttttgggatataataaatgctttcatatacctgcaaaattttaat

SEQ ID NO: 426633 - DNA, 2395 bp, Homo sapiens
  misc_feature (13)..(14): n is a, c, g, or t
  misc_feature (17)..(17): n is a, c, g, or t
  misc_feature (24)..(24): n is a, c, g, or t
tacagtctggtcnnccncgagtantggcatatcgtcgacccagccccgcgattacaccggaggcacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggtcagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaattttttttctaagaagctgtcctacaaagttgagctttgttagtttttcatgtgtaatatattataaatttatcttttgggatataataaatgctttcatatacctgcaaaattttaat

SEQ ID NO: 426634 - DNA, 5252 bp, Homo sapiens
gagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctggaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtgtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggtcagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaattttttttctaagaagctgtcctacaaagttgagctttgttagtttttcatgtgtaatatattataaatttatcttttgggatataataaatgctttcatatacctgcaaaattttaat

SEQ ID NO: 426635 - DNA, 5241 bp, Homo sapiens
gagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctggaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggtcagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaattttttttctaagaagctgtcctacaaagttgagctttgttagtttttcatgtgtaatatattataaatttatcttttgggatataataaatgctttcatatacctgcaaaattttaat

SEQ ID NO: 426636 - DNA, 5309 bp, Homo sapiens
gagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctggaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggtcagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaattttttttctaagaagctgtcctacaaagttgagctttgttagtttttcatgtgtaatatattataaatttatcttttgggatataataaatgctttcatatacctgcaaaattttaat

SEQ ID NO: 426637 - DNA, 5260 bp, Homo sapiens
gagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctggaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggtcagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaaagcaagaccctgtcttaaaaaaaaaaagaaaaaaaaattttttttctaagaagctgtcctacaaagttgagctttgttagtttttcatgtgtaatatattataaatttatcttttgggatataataaatgctttcatatacctgcaaaattttaat

SEQ ID NO: 426638 - DNA, 5303 bp, Homo sapiens
gagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctggaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggtcagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctaacttgccagctctttcagccgccgaggaccggaagagtccttgcaaactcaggaagatgaagacactcgtcctgagcaatctcagcgatacccgcgtctagagtatgatatcttacattacagcggttcctgttgaacaggccatgactgaatgttactgcgctgaggatgagctggatgatctgagcctctggatattgacggctgcagtgagatgtccatgcagattacactcagtctagtcatcagttgcagctccgttctctcttttctct

SEQ ID NO: 426639 - DNA, 1251 bp, Homo sapiens
acagacacctccgttgccaaaccaagacatggcattttctaaatgaatcagaggagcttttttcttggaacagggagttggtttgaaggtaaatacacttttttctttaacctgctgagcactaacaaagctggatcatcagcatattctgaccttctgaatccccaccatgtgttaccatggtgatgaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaattttttttctaagaagctgtcctacaaagttgagctttgttagtttttcatgtgtaatatattataaatttatcttttgggatataataaatgctttcatatacctgcaaaattttaat

SEQ ID NO: 426640 - DNA, 3153 bp, Homo sapiens
  misc_feature (3096)..(3096): n is a, c, g, or t
  misc_feature (3106)..(3106): n is a, c, g, or t
  misc_feature (3117)..(3117): n is a, c, g, or t
gagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctggaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctctttttacaacagggaaaaagtaaggangagacatacngaagggcgatntgtcaatccgtacagccaaatgctatgcggatgcgt

SEQ ID NO: 426641 - DNA, 860 bp, Homo sapiens
acagtggttcccattgtgagtgtgctagccccggagaagctgtcagccagcactaggaggcgctatgaaactcaggtacaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaaagcaagaccctgtcttaaaaaaaaaaagaaaaaaaaattttttttctaagaagctgtcctacaaagttgagctttgttagtttttcatgtgtaatatattataaatttatcttttgggatataataaatgctttcatatacctgcaaaattttaat

SEQ ID NO: 426642 - DNA, 334 bp, Homo sapiens
cccacttcgcctaagtttccagaagactttgacgatggagagcatgcaaagcaggtaattttctgatgcgtcaattactatgtcttcagtcttgcattttaattattatttttcttctttttcaattagtaatcttctgccactcattctcttgtgtcctgggaacaacgtggggaaaaaatatgaaaagatgaagcacttaaaatgtcattagacttgaactacaccataaaaatgccaagggctggcacagaaaattaacaaactgcagggttcttttgtgcaattcgttgtgcttttgaagtgctatttggacccttggcttagctgttga

SEQ ID NO: 426643 - DNA, 386 bp, Homo sapiens
gagtatatagtgaagttttgatacatataatgtatagtgatcggatcagggtaattagcacatccgtcactgcaaatatttagcatttctttgtgttggaaacattcaatatcctccttctagctattttaaacgattaaaagttaagttcaattttatttcacttgtaaacattcagcttaaaatttgcattctatactgaattaataattatgtaccatgattttcttccatgtatgacttacatctaaagtaagttttacttttcttgttctaggaacgtttggaaattgctagtttgtcaaaccaagatcatacctctaagaaggacccaggaggacacagaacggctgccattctacatggaggctctcctgactttgtag

SEQ ID NO: 426644 - DNA, 706 bp, Homo sapiens
ccaagatcatttacaaacattattagaattaatgtgagagtcagcaaggtgattccattgttgaacgttctttagttcagacataaagagttggaaaatataattttaaagatgtcatttataacatgaagaaattacaggccagccatggtggctcatgactgtaagctcagggctttgggaggattgcttaaggccagcagtttgagaccagcatgggcaacatagcaagaccttatctctataaaaataaaaaaattaatcaggtgtggaggcacagacctgtagtactagctactcaggaggctgagaagagaagatctcttgagcccaggagtttgaggcagcagtgagctgtgattacaccacagcagtccagcctgagtgacagagtgagactccatctcttaaaaaaaaaaaattacggagtatcttgcaagaaatctaataaaagatatttaaaagttttatgaagaaaattacaaaaagcggtagacttttactttgtgatccagcgcatgaggagcttggaagtcaccacctgtcctagcaacaaggaaaaactgaacaaactgaaaaatcaacaactcctcttggatctgtcagagaagcgaggtcacagggcaaattgctgtcccccaaattggtgagacagactgcgaatacagagaaccacagcttagagcagaagctccacagaaaccag

SEQ ID NO: 426645 - DNA, 764 bp, Homo sapiens
cgagcagcttggctaaaagtaagggtgtcgtgctgatggccctgtgcgcactgacccgcgctctgcgctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccgttttaatctgttactgtggttttgttttgggtgttttttgttttttttgttgttgttttttttttgcgggggaggggatggtacagactaaacgtggggaaaagaagtaaaaagtgtggaagagaaagtacaggacactgggtctgtccccaccccaattcccttacaagtaatggagccggggatggaaataaatgacgtccaaggtcaaaaaa

SEQ ID NO: 426646 - DNA, 554 bp, Homo sapiens
cgagcagcttggctaaaagtaagggtgtcgtgctgatggccctgtgcgcactgacccgcgctctgcgctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgggaacaaggacagggggatttaagcagtcaaaaggaaaaacatgttaagaccctagacttgtatattgacacacttgtaccttgtaaggcagaggaatgtaattaaaaagcacttatttggaaaaaaacaacaaaaacacaaaaaggggcggcccgcccaagagtttcccccgaggggggcccacaaagttaaacggcgtatcaccagggtgttctcattggacacagaagggtggccccctaattgggag

SEQ ID NO: 426647 - DNA, 1047 bp, Homo sapiens
acagaatctccatctgttttctctgtcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccggtaaaacaaaaaaaaaagaaaaaaaaaaaaagaaaaaaaaaaaacaaaaaaaaagaaaaaaaaaacaaaaaaaaaaacaaaaaaagcaaaaacaaacaagaaagaacaaacagacaaaagacaaacaagaaacgacaccatcaacaaaaaaaagagagaagagggggcgaaggggggacaagccgaggcacgacgggaggggcggggacgcgggcggcggccgggacccgccactagagcagagcgggagagggagcgagacgcacgagggggaggcgaagcacagagcgaggagagcggcgggggggggcgggcgcacaggcagagcacgcgaagcgggggggcagagaagcaacagagcagtcagagacagagaagagcagcaagggacaggcgagagggaggagagagcagcaccggggccgggatagcggagcagacgcacaccggcagcggagacacaaccgaccgcgatcgggcagaacaactcacgagcgaaggaccgcgaacgaaagaacaagatacaaggagtagtggaccgcgcgaacaagatctgcggacagagccggcctgcgcgacaagctagaaccgagcacgatagctcgagagactggaggtagcaggaggcgcgcgcgccagcagggcacggacgtacaggttcagagggcgaaggcgggaaaataaggcgagcaagaaagggacgacagagaagcgaccgggcgagcgaaggagcgggcagacagtgacgaacgggagggcgaggcaagag

SEQ ID NO: 426648 - DNA, 899 bp, Homo sapiens
cgagcagcttggctaaaagtaagggtgtcgtgctgatggccctgtgcgcactgacccgcgctctgcgctctctgaacctggcgcccccgaccgtcgccgcccctgccccgagtctgttccccgccgcccagatgatgaacaatggcctcctccaacagccctctgccttgatgttgctcccctgccgcccaagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgagctgcagggacgtgtggtgtgctactgcggaaggtgaatggcacagccattatccagctgccctctaagaggcagatgcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccgttttaatctgttactgtggttttgttttgggtgttttttgttttttttgttgttgttttttttttgcgggggaggggatggtacagactaaacgtggggaaaagaagtaaaaagtgtggaagagaaagtacaggacactgggtctgtccccaccccaattcccttacaagtaatggagccggggatggaaataaatgacgtccaaggtcaaaaaa

SEQ ID NO: 426649 - DNA, 1130 bp, Homo sapiens
cgagcagcttggctaaaagtaagggtgtcgtgctgatggccctgtgcgcactgacccgcgctctgcgctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgagctgcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccgttttaatctgttactgtggttttgttttgggtgttttttgttttttttgttgttgttttttttttgcgggggaggggatggtacagactaaacgtggggaaaagaagtaaaaagtgtggaagagaaagtacaggacactgggtctgtccccaccccaattcccttacaagtaatggagccggggatggaaataaatgacgtccaaggtcaaaaaa

SEQ ID NO: 426650 - DNA, 424 bp, Homo sapiens
cgagcagcttggctaaaagtaagggtgtcgtgctgatggccctgtgcgcactgacccgcgctctgcgctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgggaacaaggacagggggatttaagcagtcaaaaggaaaaacatgttaagaccctagacttgtatattgacacacttgtaccttgtaaggcagaggaatgtaattaaaaagcacttatttgg

SEQ ID NO: 426651 - DNA, 1204 bp, Homo sapiens
cgagcagcttggctaaaagtaagggtgtcgtgctgatggccctgtgcgcactgacccgcgctctgcgctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgagctgcagggacgtgtggtgtgctactgcggaaggtgaatggcacagccattatccagctgccctctaagaggcagatgcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccgttttaatctgttactgtggttttgttttgggtgttttttgttttttttgttgttgttttttttttgcgggggaggggatggtacagactaaacgtggggaaaagaagtaaaaagtgtggaagagaaagtacaggacactgggtctgtccccaccccaattcccttacaagtaatggagccggggatggaaataaatgacgtccaaggtcaaaaaa

SEQ ID NO: 426652 - DNA, 637 bp, Homo sapiens
aagagcaaagcaagggcagcatgtggggtatgtcccctgtgtaagtccctctgcacccccctgttttgtggagggtggcaaatcagcttctttccccagggacgtgtggtgtgctactgcggaaggtgaatggcacagccattatccagctgccctctaagaggcagatgcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccgttttaatctgttactgtggttttgttttgggtgttttttgttttttttgttgttgttttttttttgcgggggaggggatggtacagactaaacgtggggaaaagaagtaaaaagtgtggaagagaaagtacaggacactgggtctgtccccaccccaattcccttacaagtaatggagccggggatggaaataaatgacgtccaaggtcaaaaaa

SEQ ID NO: 426653 - DNA, 1411 bp, Homo sapiens
agccattagctaggtacggactggggtaatcggctagggcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426654 - DNA, 1888 bp, Homo sapiens
gaaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctgaaatgacagtgagtagctgcgcctggatttgagttctgctctggccaatccccaagctccacgctgtcagccaccccgctctcctacctcccagaggagcaggctacactcctgttccttttagagagagaaatattgcggccgggcgcggtggctcacgtctgtaatcccagcattttggcaggccaagggttttgccatgttcgtggggctggtctcaaactaattacctcagatgatccgcccacctcggcctcccaaagtgctgggattacagccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagagttccagctcctaaaatatttgctcctaaaatcttgaccacctgactttccggattgggatgccgttctgtgcgcctcaaatactctgtagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426655 - DNA, 1867 bp, Homo sapiens
caggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426656 - DNA, 1477 bp, Homo sapiens
agccattagctaggtacggactggggtaatcggctagggcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccgggaaaaaaaccgccttaaaaaacggcgcaccacaaagactatatcccacacctgaatcaaaagctcct

SEQ ID NO: 426657 - DNA, 1803 bp, Homo sapiens
agccattagctaggtacggactggggtaatcggctagggcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctggtaatctacaccacccacacataacccggcctcaggccagctcccctggaacggtcactcttgctcagttctctcttgacctcagccttgagactggcagaagagcaggatagggtgctagcagactcccaggggcctctcagggttacctgttggggtggcggggtgaggggctctggtgccccactccacactctcatacgctctctatcttctcatagctatcagctggcccagcggaccttccgcacttttgatttctacaagaaacaccaagaaaccatgactccagccggcttgtccttcttccagtgccgctgggatgactccgtcacctacatcttccaccagcttctgggtaagggccatggggctggggcactgggtgggcctgagctcccaggcctcgcctgccctgccagggagaagctttgttaggggaaggctgcggcaggtccctggtgggcaggcctcagcctgagggggcgcaggccagcagaccaccccgtacccctcactcttcttgcagacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426658 - DNA, 1071 bp, Homo sapiens
agccattagctaggtacggactggggtaatcggctagggcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgtattcagtggcccagggactttccgattttgatttctacagaacacagaacatgattccagcgggtgtcttttcatggcgtggatgtccgtactattttcacgtttggattcggacgtgtgattgggggccttaccaaag

SEQ ID NO: 426659 - DNA, 1335 bp, Homo sapiens
  misc_feature (2)..(2): n is a, c, g, or t
  misc_feature (9)..(9): n is a, c, g, or t
  misc_feature (11)..(11): n is a, c, g, or t
anccccccngntttggaataaccggctccgacccacgcgtccgggcagagcacccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426660 - DNA, 2306 bp, Homo sapiens
caggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggtaaccactcacttgtgcccctcctccctgccctgtgcaaacacagacacatcccatctcagtgtcacagacactcctgggtttggaattttgttgttctctgtctctttgatttcctggaagacgacaccatgacaatttcaaagaaaatagaacaaaatgaaggaaaaagaggctctgtcttagcacattcctgtgaccagcctgctgtctgtggtgttgccctcctggcccggccttggcacatgttcgtttttgtggttgttgcctggacaggcaactctgcagggctgcttctctacgcatccctttgcctgcctgcctgtgccaggggttgtcaagggcttttgggtcagagtgggcacccctttctccaaggctccctgcaacagctggcctgtccctggtggggctgacagcttccttctcaccctgccaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426661 - DNA, 2164 bp, Homo sapiens
caggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctgtgagtactggagtactgggggtagggggtgctgcccaggcgggaagaggagctgggagcctggactgagctgctcctgagtttcatggactacccatgggaccttgaattcacctgccacctctgcctcctgagggtgttaggggccctgggatccacgtgtctacttgaagacagctacaggagacaaagtttgcagtaggcctcgagacagggtttcaccatgttgcccaggctggtctcctgagctcaagcgatctgcccgcctccgcctcccaaagtgctaggattataagcaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426662 - DNA, 3013 bp, Homo sapiens
caggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctgtgagtactggagtactgggggtagggggtgctgcccaggcgggaagaggagctgggagcctggactgagctgctcctgagtttcatggactacccatgggaccttgaattcacctgccacctctgcctcctgagggtgttaggggccctgggatccacgtgtctacttgaagacagctacaggagacaaagtttgcagtaggcctcgagacagggtttcaccatgttgcccaggctggtctcctgagctcaagcgatctgcccgcctccgcctcccaaagtgctaggattataagcgtgagccaccatgcctgggcccttcgtctctaaactcatttcttcacctgtaaaactgggataatggcaccacatgccttactcagcgtgaggtggactgtgacagtcacgtgggagaaggagcgggagaggcctagcagctgtggcgtcccccaggtgctccttgaaccactgggcgctccttccctgggcccagactggcggccttccatcttggtagcttttggctctgaacaccaggccagggggcagaggtcaggccagtgaccccaactttgagccttctggttaactggggacagtgactgggaggctggtttccgtcatttttattcaactgttaccagcctatgcggcaggaccctctggggatttgtgcctgaggcgttggccgcccctgtgccaggctgggcacacactccctgacgaggtcctggagacttcaggacgcagagggaaaagcagccaaaagtggcctggctttctagcctcagtgactgtggcggacccaccggctcccggggcctggaagcggctgcatggccttgctgtcaagctgatgctctctggagccctgtcccccactcggagctcctccagcccgcttcccgtatttgcagcatgtcccggcgttcacagagcttggctgcctcctctgtcccaggagagagatgcttagagctgtcctcccagggagtcatgtcagcctctagggtgtgcatggagctgaggggacactcctgctgcctccctggagtggtaattaaccgggactttcctcctcccagaaccaacatcccgggtaaccgggtggctgaaggacaggtgacgtgtccctacctcccccccttccctgcccgaggctccggcatccaccgtcttgccttcctgctcttcaagcaggaccaccggcttgtccttcttccagtgccgctgggatgactccgtcacctacatcttccaccagcttctgggtaagggccatggggctggggcactgggtgggcctgagctcccaggcctcgcctgccctgccagggagaagctttgttaggggaaggctgcggcaggtccctggtgggcaggcctcagcctgagggggcgcaggccagcagaccaccccgtacccctcactcttcttgcagacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426663 - DNA, 2126 bp, Homo sapiens
caggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggtaaccactcacttgtgcccctcctccctgccctgtgcaaacacagacacatcccatctcagtgtcacagacactcctgggtttggaattttgttgttctctgtctctttgatttcctggaagacgacaccatgacaatttcaaagaaaatagaacaaaatgaaggaaaaagaggctctgtcttagcacattcctgtgaccagcctgctgtctgtggtgttgccctcctggcccggccttggcacatgttcgtttttgtggttgttgcctggacaggcaactctgcagggctgcttctctacgcatccctttgcctgcctgcctgtgccaggggttgtcaagggcttttgggtcagagtgggcacccctttctccaaggctccctgcaacagctggcctgtccctggtggggctgacagcttccttctcaccctgccaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426664 - DNA, 1450 bp, Homo sapiens
  misc_feature (1307)..(1307): n is a, c, g, or t
  misc_feature (1312)..(1312): n is a, c, g, or t
  misc_feature (1320)..(1320): n is a, c, g, or t
  misc_feature (1322)..(1322): n is a, c, g, or t
  misc_feature (1331)..(1332): n is a, c, g, or t
  misc_feature (1334)..(1334): n is a, c, g, or t
  misc_feature (1339)..(1339): n is a, c, g, or t
  misc_feature (1343)..(1344): n is a, c, g, or t
  misc_feature (1357)..(1357): n is a, c, g, or t
  misc_feature (1364)..(1365): n is a, c, g, or t
  misc_feature (1373)..(1373): n is a, c, g, or t
  misc_feature (1379)..(1379): n is a, c, g, or t
  misc_feature (1381)..(1382): n is a, c, g, or t
  misc_feature (1384)..(1384): n is a, c, g, or t
  misc_feature (1387)..(1387): n is a, c, g, or t
  misc_feature (1390)..(1390): n is a, c, g, or t
  misc_feature (1403)..(1404): n is a, c, g, or t
caggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgttggagccagatgctgagtacctcactggtggtaaccaatccgggtacgggtggtgaagacagtgacgtgtcctaactccccccttcctggcgaggtcggatcacgttgcttcngcctnagcggacngngatgatctnngngaggngccnncctgtttgtgccnggcttcnnttgtttcngaaccnanngnccnggngccttcgcggggnnccccattccctggaggaactgttgggaaaacacgggacgccacttg

SEQ ID NO: 426665 - DNA, 1417 bp, Homo sapiens
ctgctccgcccctctctgcccgaggctccggcatccaccgtcttgccttcctgctcttcaagcaggaccagccgattgacttctctgaggacgcacgcccctcaccctggtaatctacaccacccacacataacccggcctcaggccagctcccctggaacggtcactcttgctcagttctctcttgacctcagccttccatcttggtagcttttggctctgaacaccaggccagggggcagaggtcaggccagtgaccccaactttgagccttctggttaactggggacagtgactgggaggctggtttccgtcatttttattcaactgttaccagcctatgcggcaggaccctctggggatttgtgcctgaggcgttggccgcccctgtgccaggctgggcacacactccctgacgaggtcctggagacttcaggacgcagagggaaaagcagccaaaagtggcctggctttctagcctcagtgactgtggcggacccaccggctcccggggcctggaagcggctgcatggccttgctgtcaagctgatgctctctggagccctgtcccccactcggagctcctccagcccgcttcccgtatttgcagcatgtcccggcgttcacagagcttggctgcctcctctgtcccaggagagagatgcttagagctgtcctcccagggagtcatgtcagcctctagggtgtgcatggagctgaggggacactcctgctgcctccctggagtggtaattaaccgggactttcctcctcccagaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426666 - DNA, 1512 bp, Homo sapiens
caggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagtgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426667 - DNA, 923 bp, Homo sapiens
caggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagagttacggaggcgtcgttacgga

SEQ ID NO: 426668 - DNA, 650 bp, Homo sapiens
gcctctggaccaatctgagacctccctgctctgtgagtactggatactggggtaggggttcttcccagccgggaagaggagctgggagcctggactgagctgctcctgagtttcatggactacccatgggaccttgaattcacctgccacctctgcctcctgagggtgttaggggccctgggatccacgtgtctacttgaagacagctcaggagactgagttggggaggttaaggctgcagtgagtcatgaccctgtttttcccacacatcttcccactccagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgccatcttcgggatcctctaacgact

SEQ ID NO: 426669 - DNA, 1621 bp, Homo sapiens
agccattagctaggtacggactggggtaatcggctagggcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccgggaaaaaaccacaccacacacacaacagcacaacagacacacgcgaacaacccacatgcaccgcggagcgcctcccattcaccgaccgcgggcccacaccaacgagcggctgaagaaaaacgccaccggtgccacaaccggcgctcccgcgcacccacgcgtcgtgggccacgagggggaaaaatgcgcagatcccccaaagagacgccaac

SEQ ID NO: 426670 - DNA, 1582 bp, Homo sapiens
agccattagctaggtacggactggggtaatcggctagggcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctgggtaagggccatggggctggggcactgggtgggcctgagctcccaggcctcgcctgccctgccagggagaagctttgttaggggaaggctgcggcaggtccctggtgggcaggcctcagcctgagggggcgcaggccagcagaccaccccgtacccctcactcttcttgcagacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426671 - DNA, 1161 bp, Homo sapiens
agccattagctaggtacggactggggtaatcggctagggcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgtatcagtggccagcggacttcgactttggattctacagaaaaccagaaacagatccagcggttgtcttctccattgccggggatgactcggtactacatctccacagattcggaagcgggagcgaggtgagtcgtgggagccattaacacagaaagactccaagggaccgccaacgaacgtagggacaagaccacggataaaaagcaaggggaacacgctcacgcacaaa

SEQ ID NO: 426672 - DNA, 2952 bp, Homo sapiens
caggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctgtgagtactggagtactgggggtagggggtgctgcccaggcgggaagaggagctgggagcctggactgagctgctcctgagtttcatggactacccatgggaccttgaattcacctgccacctctgcctcctgagggtgttaggggccctgggatccacgtgtctacttgaagacagctacaggagacaaagtttgcagtaggcctcgagacagggtttcaccatgttgcccaggctggtctcctgagctcaagcgatctgcccgcctccgcctcccaaagtgctaggattataagcgtgagccaccatgcctgggcccttcgtctctaaactcatttcttcacctgtaaaactgggataatggcaccacatgccttactcagcgtgaggtggactgtgacagtcacgtgggagaaggagcgggagaggcctagcagctgtggcgtcccccaggtgctccttgaaccactgggcgctccttccctgggcccagactggcggccttccatcttggtagcttttggctctgaacaccaggccagggggcagaggtcaggccagtgaccccaactttgagccttctggttaactggggacagtgactgggaggctggtttccgtcatttttattcaactgttaccagcctatgcggcaggaccctctggggatttgtgcctgaggcgttggccgcccctgtgccaggctgggcacacactccctgacgaggtcctggagacttcaggacgcagagggaaaagcagccaaaagtggcctggctttctagcctcagtgactgtggcggacccaccggctcccggggcctggaagcggctgcatggccttgctgtcaagctgatgctctctggagccctgtcccccactcggagctcctccagcccgcttcccgtatttgcagcatgtcccggcgttcacagagcttggctgcctcctctgtcccaggagagagatgcttagagctgtcctcccagggagtcatgtcagcctctagggtgtgcatggagctgaggggacactcctgctgcctccctggagtggtaattaaccgggactttcctcctcccagaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426673 - DNA, 2320 bp, Homo sapiens
caggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctgtgagtactggagtactgggggtagggggtgctgcccaggcgggaagaggagctgggagcctggactgagctgctcctgagtttcatggactacccatgggaccttgaattcacctgccacctctgcctcctgagggtgttaggggccctgggatccacgtgtctacttgaagacagctacaggagacaaagtttgcagtaggcctcgagacagggtttcaccatgttgcccaggctggtctcctgagctcaagcgatctgcccgcctccgcctcccaaagtgctaggattataagcgtgagccaccatgcctgggcccttcgtctctaaactcatttcttcacctgtaaaactgggataatggcaccacatgccttactcagcgtgaggtggactgtgacagtcacgtgggagaaggagcgggagaggcctagcagctgtggcgtcccccagaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426674 - DNA, 2477 bp, Homo sapiens
caggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgggcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctgtgagtactggagtactgggggtagggggtgctgcccaggcgggaagaggagctgggagcctggactgagctgctcctgagtttcatggactacccatgggaccttgaattcacctgccacctctgcctcctgagggtgttaggggccctgggatccacgtgtctacttgaagacagctacaggagacaaagtttgcagtaggcctcgagacagggtttcaccatgttgcccaggctggtctcctgagctcaagcgatctgcccgcctccgcctcccaaagtgctaggattataagcgtgagccaccatgcctgggcccttcgtctctaaactcatttcttcacctgtaaaactgggataatggcaccacatgccttactcagcgtgaggtggactgtgacagtcacgtgggagaaggagcgggagaggcctagcagctgtggcgtcccccaggtgctccttgaaccactgggcgctccttccctgggcccagactggcggccttccatcttggtagcttttggctctgaacaccaggccagggggcagaggtcaggccagtgaccccaactttgagccttctggttaactggggacagtgactgggaggctggtttccgtcatttttattcaactgttaccagcctatgcggcaggaccctctggggatttgtgcctgaggcgttggccgcccctgtgccaggctgggcacacactccctgacgaggtcctggagacttcaggacgcacgctctctatcttctcatagctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426675 - DNA, 783 bp, Homo sapiens
gcacgaggtgtactgtggcaatgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426676 - DNA, 800 bp, Homo sapiens
cctggtgggctcatgactgtccctgtaccggtccaggtagcgcaggggctgccggagggggaagcgcttctgcttggggtggtaagggggcggccgcacgaactcaaacactcctgctgcctccctggagtggtaattaaccgggactttcctcctcccagaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccggg

SEQ ID NO: 426677 - DNA, 531 bp, Homo sapiens
ggggctcaccaggcctcctgccccgctcacctcctatgagccagggccctggggggctgggggaggggccaggtggagatctccagcgctggctcctaacaagggagggggtggcagggccgtggtcggctgggccgtggtcagcaggtgtgtttttgtgcagatgggcacctgctggagccagatgctgagtacctccactggctgctgtgagtactggagtactgggggtagggggtgctgcccaggcgggaagaggagctgggagcctggactgagctgctcctgagtttcatggactacccatgggaccttgaattcacctgccacctctgcctcctgagggtgttaggggccctgggatccacgtgtctacttgaagacagctacaggagacaaagtttgcagtaggcctcggtcagtccccacaagcctcctcatcttttcttttcttttttttttttttttttgagacagggtctcactctgtcccccaggctggagtacagtggtgcaatcatggctaattgc

SEQ ID NO: 426678 - DNA, 925 bp, Homo sapiens
  misc_feature (770)..(770): n is a, c, g, or t
  misc_feature (800)..(800): n is a, c, g, or t
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactggtactgaagatggatggggatcattaggtttctcttattatattgtcccacaaatatcttaaccgtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgtatgtngtgaaatgtataactgaagaagaggacagntttgatttcataggtggtttgactcttatggctatcacgggcctcagaagacatctcatttacagcttacagcctatgtacatgtcaagataagtccggatgacttcggtatgtcaggcccatgg

SEQ ID NO: 426679 - DNA, 581 bp, Homo sapiens
  misc_feature (518)..(518): n is a, c, g, or t
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactgagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactggngatcggccggcaaaccatactctctcaaccacgttatccaccgcccccgagcgcgagcgccac

SEQ ID NO: 426680 - DNA, 573 bp, Homo sapiens
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactgagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactgggcagcggccagatggcaattagcacgtctgtgggaaaagaacgcgggtgggggaca

SEQ ID NO: 426681 - DNA, 861 bp, Homo sapiens
  misc_feature (706)..(706): n is a, c, g, or t
  misc_feature (736)..(736): n is a, c, g, or t
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgtatgtngtgaaatgtataactgaagaagaggacagntttgatttcataggtggtttgactcttatggctatcacgggcctcagaagacatctcatttacagcttacagcctatgtacatgtcaagataagtccggatgacttcggtatgtcaggcccatgg

SEQ ID NO: 426682 - DNA, 853 bp, Homo sapiens
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactggtactgaagatggatggggatcattaggtttctcttattatattgtcccacaaatatcttaaccgtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaagcacccatctgtgaactggtggaaggagccatgtttatcaaacagagagtggaagaaagcaccagaactgcaaatccagaatttcagtctacagagtaaggaagggacaaggctggccctgcatctattcctgtagaccctgcaatgccaggggatatagcacaaggccattgtaagttccatgaggaactaggaaagagaaaaaaaaaagagaagcatctaaaaatatgttaaaagttcacatttctggtgctgttttggacattttttatgggaaagttctttgtaagtaatacaatatctttgaaagaaaa

SEQ ID NO: 426683 - DNA, 378 bp, Homo sapiens
  misc_feature (39)..(39): n is a, c, g, or t
  misc_feature (315)..(315): n is a, c, g, or t
ccagtgttccgcgcggcgagcagcacggggacagggggngggggggtcaggagtagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactggngatcggccggcaaaccatactctctcaaccacgttatccaccgcccccgagcgcgagcgccac

SEQ ID NO: 426684 - DNA, 480 bp, Homo sapiens
gtttacttttgtagacactgcctaaatagaaatagaaattctggtgatttcaataacatcaaaaatgacaaattacctgtttaacttaaaaaggtcatgaatgaggccttcagagaaataatattaataatataatgaataaccatagagcagtgcctttaaattagctataggaaggaaatagtcttttcaagtttctgaacaatatatttctcttagttggcacctcacaaatactagatcatgtcagacgctgctggttaatagctgcaggaaggcatgttgtgcagtggatattgctcatggaagtgtgtgaaaatcatagtaagctttgttctccctgctaagacttgctatgtatatttccatcattgtttcatgtaaactgaaccattgtggtaaacttttggagttgatatggaatcactttaatgctgttttcacaaataaaagttttttcttataggtcaaaaaaaaaac

SEQ ID NO: 426685 - DNA, 285 bp, Homo sapiens
catacacttcgagctcgtaccgctcagccgaggtggttgctctactggggccttatcgaacagctcggtatcggctggtgccatcatctaagtatagactgtgaggagctgcatgttggcatcattcggttgtggacggtgtctagcaaggaggagaatctgcaagtattgcagaggtgggagacttgcgtgtctccttttcctatgctggactgagcggcgatgaccctgacctgggcccagctcacgtggtaacctggcttcccaggggcagacactaagtca

SEQ ID NO: 426686 - DNA, 389 bp, Homo sapiens
cgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaatctgtccaggcttcttttgtccgtgttccttggctcgcctcgtcctcggcgttcgtgcggaggcggactcggaggtgttgctcccgtactgggatctgcttgtacgcctctccgcggcccctccttgcattcccagttccctcctgtaccttggggccctgaaacttgcgcattatgagagctggacgcgacct

SEQ ID NO: 426687 - DNA, 2760 bp, Homo sapiens
cgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccagga

SEQ ID NO: 426688 - DNA, 3279 bp, Homo sapiens
cgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctctgtccacccaaatcaggaatatcgctgtcccttccatgaaaacatgtgtcattaatttataaaggttcatggata

SEQ ID NO: 426689 - DNA, 3218 bp, Homo sapiens
cgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttctaagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattatc

SEQ ID NO: 426690 - DNA, 2351 bp, Homo sapiens
cgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggcgcccccccggggcatgcgctccgatccgccccccaccccccctctcccgtttttgggtcccccccaaagcctttacaatggatgccttttgaaacaaagtattatccaaaaggga

SEQ ID NO: 426691 - DNA, 630 bp, Homo sapiens
cgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgaggtaaaatgtctggggtcttcctgtgcagagtgagagtccccaccatgtcagagagcaaaggcgatgaacccggaggctggatttggtaatcaagggcctagattttaaaaagagaaaggaggatactgagttaatcacagttctttccattgtgatccatcccacagctgatgtgagcaggaaggggagtagatcagttcacacacctgaatatccaggggttagcacctgcctcaggcgtagttggatccaggtgttcatgctgggtcaccaggaatctccat

SEQ ID NO: 426692 - DNA, 389 bp, Homo sapiens
ggaatctgggttccagtccttactctccacttgctagacctcagttttccaactgtacggtggggagatgggtctcagcgctcccggaggccccatcctaccctaatactttgcaacaagcacagtcatgctgagccacccctgagctgttgaaatccccactcccctttgctcccagggccgcgcattgaagacggcaacctcattggctgaggggctctcgcttgtggtgtctcccgacagcatccacagtgtggctccggagaatgaaggaaggctggtgcacatcattggcgccttacggacatccaaggtaggtttggcaggggatgctgacctgccagtggctcggggctcatcctggatgttgtctggctgaggatttgaaa

SEQ ID NO: 426693 - DNA, 375 bp, Homo sapiens
acaggagacagagtgagggtgctcagcccaggggagggggcacagggcccctgggggtggacaggacaagatgtctgctgcgcctgggctaatctggacttgcaggaacccccgggtggggaccctgcccagcacaaacaacccaaagggacccgggcagctcccacaccggtgcccatctctgacagcttcctctctcccacagtgccatggcagtggagtcattcatggcaacagccccctttgtccaaattggcaggtttttcctctcgtcaggtaagtctcaggcctctccagaggagctcgtgccagaagcacaaggcccccctagggccggagctcccagtactcagccttcagagggctaaaggcaca

SEQ ID NO: 426694 - DNA, 3272 bp, Homo sapiens
cgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattatc

SEQ ID NO: 426695 - DNA, 265 bp, Homo sapiens
tcccctgggtttctaaccactctggtcccctcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtaacctggcttcccaggggcagacactaagtca

SEQ ID NO: 426696 - DNA, 3326 bp, Homo sapiens
cgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattatcaaaaaaaaagcaacgcaacgcaaacacaccacgccacgacaaccaacacaaggg

SEQ ID NO: 426697 - DNA, 3148 bp, Homo sapiens
cgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaaccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattatc

SEQ ID NO: 426698 - DNA, 2082 bp, Homo sapiens
cgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattatc

SEQ ID NO: 426699 - DNA, 2270 bp, Homo sapiens
cgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaatagatttcacacacgagaaccttacttttcgaacgtccagggaaaaccttggtggccactgattcaagcctgaagggttcaatgggcatgtggtgtgcggatccctcatgggtctgcttcaggggttggcc

SEQ ID NO: 426700 - DNA, 446 bp, Homo sapiens
ggcacagcctgggcacgggtgtggaggtgggagaagagcctgaggggcgtagccgaggcatcctggacctgggcctgggccagctactccgttcctcactctccctgcttctcttccacccccaggtgggagacttgcgtgtctccttttcctatgctggactgagcggcgatgaccctgacctgggcccagctcacgtggtaacctggcttcccaggggcagacactaagtcagagcctcacgactttcctggacacagacaccttggtcaatgtcaggagcgcttggacccccttttccctggggaaaggcacactctcgcacacactctcagccaggcacgcttctgagcagtttcagagctcccatgtccccacagccatccatggaccccacgttaagaagggcagctcaaaaggggtctcatagtcgcaccttatgacag

SEQ ID NO: 426701 - DNA, 1557 bp, Homo sapiens
cccggaccccacgccgaccccggccccggggggggctcagcgacctcggcgcctcctcaggcccccagtgaacctccggggcccataaaggctccaggccggctccccggaggcccaccagcgggcgtctgggcctccctccgcgccgcgaccgccaggaggcgccgcccgggagaggaagtccagctgggcccggccgggcttcggaggcgccgcccgggagaggaagtccagttgggcccggccgggcttcagaggcgcagggcgggagccgcctcgcgcagggtcctccccaagccggcgccaggccctgccctcgtccggccctgccctcgtctggccccgcccgggccgcgagcactggcgggttctgggtcctgtgaccggtcaggcggcgtcagcgggcgcggcggagggctggccggcctcgggggagtttccgcggccgccgggggcgcggcggcagagcgcgaggccgggcagggggccagactcggagtcgaggcgcgcccgacagccgcagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaaggtcctcaactgggacagcaggactctggtgcgcctgcagctgtgggacatcgcggggcaggagcgatttggcaacatgacccgagtatactacaaggaagctgttggtgcttttgtagtctttgatatatcaagaagttccacatttgaggcagtcttaaaatggaaaagtgatctggatagtaaagttcatcttccaaatggcagccctatccctgctgtcctcttggctaacaaatgtgaccagaacaaggacagtagccagagtccttcccaggtggaccaattctgcaaagaacatggctttgccggatggtttgaaacctctgcaaaggataacataaacatagaggaagctgcccggttcctagtggagaagattcttgtaaaccaccaaagctttcctaatgaagaaaacgatgtggacaaaattaagctagatcaagagaccttgagagcagagaacaaatcccagtgttgctgatatatggcttctgcttctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctctgtaacttaacagatgacaattaggcttttgtcattgttgccatcatatggaagataatgtttacatccttttaaacatttttatatgacaattcctcaggatttggtaaggcttccaagttgtagcttttagtgtaagtgctggggtggtaataaaatgttacctccagct

SEQ ID NO: 426702 - DNA, 1427 bp, Homo sapiens
cccggaccccacgccgaccccggccccggggggggctcagcgacctcggcgcctcctcaggcccccagtgaacctccggggcccataaaggctccaggccggctccccggaggcccaccagcgggcgtctgggcctccctccgcgccgcgaccgccaggaggcgccgcccgggagaggaagtccagctgggcccggccgggcttcggaggcgccgcccgggagaggaagtccagttgggcccggccgggcttcagaggcgcagggcgggagccgcctcgcgcagggtcctccccaagccggcgccaggccctgccctcgtccggccctgccctcgtctggccccgcccgggccgcgagcactggcgggttctgggtcctgtgaccggtcaggcggcgtcagcgggcgcggcggagggctggccggcctcgggggagtttccgcggccgccgggggcgcggcggcagagcgcgaggccgggcagggggccagactcggagtcgaggcgcgcccgacagccgcagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaaggtcctcaactgggacagcaggactctggtgcgcctgcagctgtgggacatcgcgggtaagcgcggccgcgagtttcccactccagagccccgccgggccgcctggctcctctctgcttcttttctttttcttttctgcctgaactcgtctgcctgggtacctttaggagaagagagaggcccaatccaagggcgagatgcgatggacgcggtcggctggactcggtggggcccagaggatgggatgggcagtaggagttggagcaggtcctgcacgccagagctcgctctcctgaagggaggcgaggaggccagggggccttttccagaagtttgaactctgaataatgcaagtatatcatacatacaccaggactagttgagaaggctgctttggagcgggccggcgcctctcagcctcaactcaagttcagagggattgggtgacttaacccgaagctgcactcctagttagtgacaccaccaagaccaaaagccaggttcctttccagatcattttccaccacccgccttggctctgagactggcctttgtgagggaaactccattcctcaaatactttgctctcatcggaagccgaggacagacactccgtgaagatttgggaaagcttttctgaaaccttacactcaccccttcctctcttgctaaaccaacacctagtcccatccctggtgccctcgc

SEQ ID NO: 426703 - DNA, 1337 bp, Homo sapiens
cccggaccccacgccgaccccggccccggggggggctcagcgacctcggcgcctcctcaggcccccagtgaacctccggggcccataaaggctccaggccggctccccggaggcccaccagcgggcgtctgggcctccctccgcgccgcgaccgccaggaggcgccgcccgggagaggaagtccagctgggcccggccgggcttcggaggcgccgcccgggagaggaagtccagttgggcccggccgggcttcagaggcgcagggcgggagccgcctcgcgcagggtcctccccaagccggcgccaggccctgccctcgtccggccctgccctcgtctggccccgcccgggccgcgagcactggcgggttctgggtcctgtgaccggtcaggcggcgtcagcgggcgcggcggagggctggccggcctcgggggagtttccgcggccgccgggggcgcggcggcagagcgcgaggccgggcagggggccagactcggagtcgaggcgcgcccgacagccgcagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaagtcctcttggctaacaaatgtgaccagaacaaggacagtagccagagtccttcccaggtggaccaattctgcaaagaacatggctttgccggatggtttgaaacctctgcaaaggataacataaacatagaggaagctgcccggttcctagtggagaagattcttgtaaaccaccaaagctttcctaatgaagaaaacgatgtggacaaaattaagctagatcaagagaccttgagagcagagaacaaatcccagtgttgctgatatatggcttctgcttctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctctgtaacttaacagatgacaattaggcttttgtcattgttgccatcatatggaagataatgtttacatccttttaaacatttttatatgacaattcctcaggatttggtaaggcttccaagttgtagcttttagtgtaagtgctggggtggtaataaaatgttacctccagct

SEQ ID NO: 426704 - DNA, 1352 bp, Homo sapiens
cccggaccccacgccgaccccggccccggggggggctcagcgacctcggcgcctcctcaggcccccagtgaacctccggggcccataaaggctccaggccggctccccggaggcccaccagcgggcgtctgggcctccctccgcgccgcgaccgccaggaggcgccgcccgggagaggaagtccagctgggcccggccgggcttcggaggcgccgcccgggagaggaagtccagttgggcccggccgggcttcagaggcgcagggcgggagccgcctcgcgcagggtcctccccaagccggcgccaggccctgccctcgtccggccctgccctcgtctggccccgcccgggccgcgagcactggcgggttctgggtcctgtgaccggtcaggcggcgtcagcgggcgcggcggagggctggccggcctcgggggagtttccgcggccgccgggggcgcggcggcagagcgcgaggccgggcagggggccagactcggagtcgaggcgcgcccgacagccgcagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaaggtcctcaactgggacagcaggactctggtgcgcctgcagctgtgggacatcgcggggcaggagcgatttggcaacatgacccgagtatactacatggctttgccggatggtttgaaacctctgcaaaggataacataaacatagaggaagctgcccggttcctagtggagaagattcttgtaaaccaccaaagctttcctaatgaagaaaacgatgtggacaaaattaagctagatcaagagaccttgagagcagagaacaaatcccagtgttgctgatatatggcttctgcttctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctctgtaacttaacagatgacaattaggcttttgtcattgttgccatcatatggaagataatgtttacatccttttaaacatttttatatgacaattcctcaggatttggtaaggcttccaagttgtagcttttagtgtaagtgctggggtggtaataaaatgttacctccagct

SEQ ID NO: 426705 - DNA, 1278 bp, Homo sapiens
cccggaccccacgccgaccccggccccggggggggctcagcgacctcggcgcctcctcaggcccccagtgaacctccggggcccataaaggctccaggccggctccccggaggcccaccagcgggcgtctgggcctccctccgcgccgcgaccgccaggaggcgccgcccgggagaggaagtccagctgggcccggccgggcttcggaggcgccgcccgggagaggaagtccagttgggcccggccgggcttcagaggcgcagggcgggagccgcctcgcgcagggtcctccccaagccggcgccaggccctgccctcgtccggccctgccctcgtctggccccgcccgggccgcgagcactggcgggttctgggtcctgtgaccggtcaggcggcgtcagcgggcgcggcggagggctggccggcctcgggggagtttccgcggccgccgggggcgcggcggcagagcgcgaggccgggcagggggccagactcggagtcgaggcgcgcccgacagccgcagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaaggtcctcaactgggacagcaggactctggtgcgcctgcagctgtgggacatcgcggggcaggagcgatttggcaacatgacccgagtatactacaaggaagctgttggtgcttttgtagtctttgatatatcaagaagttccacatttgaggcagtcttaaaatggaaaagtgatctggatagtaaagttcatcttccaaatggcagccctatccctgctgctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctctgtaacttaacagatgacaattaggcttttgtcattgttgccatcatatggaagataatgtttacatccttttaaacatttttatatgacaattcctcaggatttggtaaggcttccaagttgtagcttttagtgtaagtgctggggtggtaataaaatgttacctccagct

SEQ ID NO: 426706 - DNA, 2923 bp, Homo sapiens
cggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaat

SEQ ID NO: 426707 - DNA, 2767 bp, Homo sapiens
gggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaat

SEQ ID NO: 426708 - DNA, 462 bp, Homo sapiens
atggtcccaattactttataagctgatacgaggcaccagtaagcgcttgtaacgtgcaaaagacaacagaaagcttaaataaaatcataaagactcataacctccatgaccatctcccacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaat

SEQ ID NO: 426709 - DNA, 2663 bp, Homo sapiens
gggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctgga

SEQ ID NO: 426710 - DNA, 2798 bp, Homo sapiens
gggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctgga

SEQ ID NO: 426711 - DNA, 2759 bp, Homo sapiens
gggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctgga

SEQ ID NO: 426712 - DNA, 2831 bp, Homo sapiens
cggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctgga

SEQ ID NO: 426713 - DNA, 2885 bp, Homo sapiens
gggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagatgggattctgctatgttgcctaggctggtctcctagcctcaagcgatcctccttccttggcctaccaaagcagtgggattacagagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctgga

SEQ ID NO: 426714 - DNA, 2787 bp, Homo sapiens
gttcgggccagatgcatcctcatggatgcgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctgga

SEQ ID NO: 426715 - DNA, 2532 bp, Homo sapiens
ccacgcgatcgtcgacccacgcgatcgcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctgga

SEQ ID NO: 426716 - DNA, 1872 bp, Homo sapiens
tgagactccatctcaaacaaacaaacaaacaaaattgtaattctagtatcaggacagattggcccaatttagcaccattctaataagatctgctttattttagacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctgga

SEQ ID NO: 426717 - DNA, 3470 bp, Homo sapiens
  misc_feature (3470)..(3470): n is a, c, g, or t
gggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 426718 - DNA, 2959 bp, Homo sapiens
gggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 426719 - DNA, 2488 bp, Homo sapiens
gggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctg

SEQ ID NO: 426720 - DNA, 1254 bp, Homo sapiens
gaaagccttgtggccacttggcactactcatcagagattctgtcccttctctccacaggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctgga

SEQ ID NO: 426721 - DNA, 1568 bp, Homo sapiens
gggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttggtccagatatgagcattgaattgtatcttcttgttaaaacactcagcataaaaggctgaaatgggtggatgatgggaaacctgctcagccacaaatgttagtcgagc

SEQ ID NO: 426722 - DNA, 947 bp, Homo sapiens
gggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagatgggattctgctatgttgcctaggctggtctcctagcctcaagcgatcctccttccttggcctaccaaagcagtgggattacagagcatggtagaatcaattaaacactgcattgtgttgctgcagattgccaaagaccagagtaatgcggagaagcacgcagatggaatgatagtaagtttaatgtaatctttttgtttccctttacttctgcagagcattataaccagtcatatcaggagaagcctgaattactactcatttttcaatgccaactactcactgctttttgttgttgactcttgcagtttcctttaagctcccttctttcagcaatcatttgcaggggaaatgacaatcttaaaatttttctaagtgtgggttcagattgaatcactttgcatgtattaacttgaagggttaatcatggtatgaatactcagcttttacaattaaataatgcataactcagtg

SEQ ID NO: 426723 - DNA, 888 bp, Homo sapiens
gttcgggccagatgcatcctcatggatgcgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgatagtaagtttaatgtaatctttttgtttccctttacttctgcagagcattataaccagtcatatcaggagaagcctgaattactactcatttttcaatgccaactactcactgctttttgttgttgactcttgcagtttcctttaagctcccttctttcagcaatcatttgcaggggaaatgacaatcttaaaatttttctaagtgtgggttcagattgaatcactttgcatgtattaacttgaagggttaatcatggtatgaatactcagcttttacaattaaataatgcataactcagtg

SEQ ID NO: 426724 - DNA, 489 bp, Homo sapiens
gaaagccttgtggccacttggcactactcatcagagattctgtcccttctctccacaggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaag

SEQ ID NO: 426725 - DNA, 1702 bp, Homo sapiens
cactcacctgaatgtgtaaggacatctttcctcaagagcttctcacttcctgaggagtctgtagtcttcattcaaatgtcttgatggctcattttccagaaatctctgtaggtcttgagaagcattgtcctagctttggtttatctgaatagtcctatttaaacttgtcccacacagatagcagcctcttgcttgcccttctgtttgtacacttgtctattttctctttctttaaatgccttttgggtgttaatacttcattggtggttccatagccttgtccccctctcttttgcaacttgaaggcaattctcagttctcttcttgagcacattcatacttagcagcttctgaatatcccacccacaattaaggtacaatctggtcacataactttttccctaggaagaaatgtgctactcaagactaatagccaaggttaagaacgtgcatactcctgaatcggatgtaaatgcattagtctatttgttctgtttagaaataaagatggaacatattttatagctactgttagtgcccatgtgccttctaaatatcttttgaatagttttacttctctccatcttgacagctaccatgccaatccaagcttccatcaccttgctcctggcttactgcagtatcctcctgtctacccttcatccacttttatctctttccaatcacttgttcatacaacagccatattgggtttttttcaaaacacacatataatcagggcacttctcaacttaaaaccatttctggcattacttgcccttaggataatgacaaaactttttaacacagtccacaaggccagagatagcctgacccttgctgatctgtccagcctctgctatatgtccccttattttctctgttccaaccacattggactttgttcctcttactagtcatgctccccacctatttggttccctagttaacttctcttcatccttcgatttcaacttgtgtcacttcctccagaaagcctaccctttctttcttaaccaggccgataggctgtcaaaaccaggaatctcttcttcgtagcactacagtcatactcattgatacgtgtgattattaatgtgggttttttaaaaaattagaatgaaactcaagagcagggaccacatctattacttgtgattaatatattcctagtggttagcacagtgtctagacaaatatatgttgaatgaataaatagaaaagggagaggaaaaagggaaggattgaccctctgtgaggcagtcttgcaaacagcagaaatgcaaagcaaagctgaagaactaactattcaacacacacctagaggagcgttgtaatgtcttgtgcctgtctcaaatgggtgcattcttatgggtaagttttactagtccagctttcactgtaatagttcacattcctctcctagtgtcagtctccaacaaatccctcagtaattcgtaatcagtaatctcatgccaaggatgagagaggggcattatccaaaaagttgggtgtgtccatttttttttgagtcttgctctgttgcccaggctggagtccagtggcatggtcttggcttactgcaacctccgcctcccaggctgaggtatgagaattgcttaaaccctggagacggaggttacagtaagctgaaatcacgccactgcactccagcctggatgacagaacaatactgtctcaa

SEQ ID NO: 426726 - DNA, 3223 bp, Homo sapiens
cactcacctgaatgtgtaaggacatctttcctcaagagcttctcacttcctgaggagtctgtagtcttcattcaaatgtcttgatggctcattttccagaaatctctgtaggtcttgagaagcattgtcctagctttggtttatctgaatagtcctatttaaacttgtcccacacagatagcagcctcttgcttgcccttctgtttgtacacttgtctattttctctttctttaaatgccttttgggtgttaatacttcattggtggttccatagccttgtccccctctcttttgcaacttgaaggcaattctcagttctcttcttgagcacattcatacttagcagcttctgaatatcccacccacaattaaggtacaatctggtcacataactttttccctaggaagaaatgtgctactcaagactaatagccaaggttaagaacgtgcatactcctgaatcggatgtaaatgcattagtctatttgttctgtttagaaataaagatggaacatattttatagctactgttagtgcccatgtgccttctaaatatcttttgaatagttttacttctctccatcttgacagctaccatgccaatccaagcttccatcaccttgctcctggcttactgcagtatcctcctgtctacccttcatccacttttatctctttccaatcacttgttcatacaacagccatattgggtttttttcaaaacacacatataatcagggcacttctcaacttaaaaccatttctggcattacttgcccttaggataatgacaaaactttttaacacagtccacaaggccagagatagcctgacccttgctgatctgtccagcctctgctatatgtccccttattttctctgttccaaccacattggactttgttcctcttactagtcatgctccccacctatttggttccctagttaacttctcttcatccttcgatttcaacttgtgtcacttcctccagaaagcctaccctttctttcttaaccaggccgataggctgtcaaaaccaggaatctcttcttcgtagcactacagtcatactcattgatacgtgtgattattaatgtgggttttttaaaaaattagaatgaaactcaagagcagggaccacatctattacttgtgattaatatattcctagtggttagcacagtgtctagacaaatatatgttgaatgaataaatagaaaagggagaggaaaaagggaaggattgaccctctgtgaggcagtcttgcaaacagcagaaatgcaaagcaaagctgaagaactaactattcaacacacacctagaggagcgttgtaatgtcttgtgcctgtctcaaatgggtgcattcttatgggtaagttttactagtccagctttcactgtaatagttcacattcctctcctagtgtcagtctccaacaaatccctcagtaattcgtaatcagtaatctcatgccaaggatgagagaggggcattatccaaaaagttgggtgtgtccatttttttttgagtcttgctctgttgcccaggctggagtccagtggcatggtcttggcttactgcaacctccgcctcccaggttcaagtaattctgcctcagcctcctgagtagctgggattacaggcgcctgctacctcgcccggcttttttgttgttgttatttttagtagagacggtgtttcaccatgttggtcaggctggtcatgaacttgtgaccttgtgatccgcccgccttggccttccaaagtgctgggattacaggcgtgagccactgtgcccggctgttcatctgtttttcaatacctttaagttcagtttcccttacaaagcccacttttttcttagtgggaatctcttgtaccacttaacacctacattccttaatttttaaagttaaaacacttatatactataaaatggacacatcttaagcatacagcttgatgaagatttacaaagtaaacatgccagttgaaacaccactctgatcaggatgtggaacataaccagcactccagaaatctctctgccatcattaccaccactggttatcctagccactcttctgacttgtatcaccatagataggttttacttgttttgaagccatctataaatggaatcatggaagtttgggcttccctgagagcagatcttcagagaaaaaaaacttgagtgcagtagtttatttggcgtttggctccaggatgcaggagtgggaaagatggtagagagacagaagaaaaatcaatagaaaggtattacggaggttggatatataatgcttcccagaattgtctgactgaacaggaggctgaaatatttatccgctggctcctgtttccaattgattgagggatgcccccaaggaagttaacttcactgcaattctgagctgtaattgactttaataagctccaacagcactgaaagacgtttggattattttcagtttgggataatactactatgaacattcctgtacatgtcttttgagaacacgcatgtgtacatttgtgatgggtatgtaatggggtggaattactggttcatagaatatgtgcatattcacctttagatatagaggctgccaaccatttttctgaagtgattatactaatttatattctcactatctgtaaatgaacatttctgttgctccacatccttgctggcacttggtattgattgatttctcttttaattttaggctttttaatacgtgtgtagtgatatctcacttgctgtttgtttgctttttggtaaattttttattgaagtataatttacatacagaaaatcacacaaattgtgtacaggtgtgatttttcacaccgtgaatacatgcaaaaactagtatgaaattaagagttggaacatcaccagtactccagaagccccatgcatgttctcttccagttactataccactatcccaaggatggtctattaattcaacagcatagatttattttgcctgtttttcaacttcaaataaatgaaataatatgcactcttgtgtctggcttctttgactcaacagtatgtctatacaactcatctgtattgttgcatgttgtagttcgttcattcatactgttgtatacagtattgaattgtataaattactcattctgttactatgcatttgggctgtttccagttttggctattatgaataaagctgctatgaacattcta

SEQ ID NO: 426727 - DNA, 3169 bp, Homo sapiens
cactcacctgaatgtgtaaggacatctttcctcaagagcttctcacttcctgaggagtctgtagtcttcattcaaatgtcttgatggctcattttccagaaatctctgtaggtcttgagaagcattgtcctagctttggtttatctgaatagtcctatttaaacttgtcccacacagatagcagcctcttgcttgcccttctgtttgtacacttgtctattttctctttctttaaatgccttttgggtgttaatacttcattggtggttccatagccttgtccccctctcttttgcaacttgaaggcaattctcagttctcttcttgagcacattcatacttagcagcttctgaatatcccacccacaattaaggtacaatctggtcacataactttttccctaggaagaaatgtgctactcaagactaatagccaaggttaagaacgtgcatactcctgaatcggatgtaaatgcattagtctatttgttctgtttagaaataaagatggaacatattttatagctactgttagtgcccatgtgccttctaaatatcttttgaatagttttacttctctccatcttgacagctaccatgccaatccaagcttccatcaccttgctcctggcttactgcagtatcctcctgtctacccttcatccacttttatctctttccaatcacttgttcatacaacagccatattgggtttttttcaaaacacacatataatcagggcacttctcaacttaaaaccatttctggcattacttgcccttaggataatgacaaaactttttaacacagtccacaaggccagagatagcctgacccttgctgatctgtccagcctctgctatatgtccccttattttctctgttccaaccacattggactttgttcctcttactagtcatgctccccacctatttggttccctagttaacttctcttcatccttcgatttcaacttgtgtcacttcctccagaaagcctaccctttctttcttaaccaggccgataggctgtcaaaaccaggaatctcttcttcgtagcactacagtcatactcattgatacgtgtgattattaatgtgggttttttaaaaaattagaatgaaactcaagagcagggaccacatctattacttgtgattaatatattcctagtggttagcacagtgtctagacaaatatatgttgaatgaataaatagaaaagggagaggaaaaagggaaggattgaccctctgtgaggcagtcttgcaaacagcagaaatgcaaagcaaagctgaagaactaactattcaacacacacctagaggagcgttgtaatgtcttgtgcctgtctcaaatgggtgcattcttatgggtaagttttactagtccagctttcactgtaatagttcacattcctctcctagtgtcagtctccaacaaatccctcagtaattcgtaatcagtaatctcatgccaaggatgagagaggggcattatccaaaaagttgggtgtgtccatttttttttgagtcttgctctgttgcccaggctggagtccagtggcatggtcttggcttactgcaacctccgcctcccaggttcaagtaattctgcctcagcctcctgagtagctgggattacaggcgcctgctacctcgcccggcttttttgttgttgttatttttagtagagacggtgtttcaccatgttggtcaggctggtcatgaacttgtgaccttgtgatccgcccgccttggccttccaaagtgctgggattacaggcgtgagccactgtgcccggctgttcatctgtttttcaatacctttaagttcagtttcccttacaaagcccacttttttcttagtgggaatctcttgtaccacttaacacctacattccttaatttttaaagttaaaacacttatatactataaaatggacacatcttaagcatacagcttgatgaagatttacaaagtaaacatgccagttgaaacaccactctgatcaggatgtggaacataaccagcactccagaaatctctctgccatcattaccaccactggttatcctagccactcttctgacttgtatcaccatagataggttttacttgttttgaagccatctataaatggaatcatggaagtttgggcttccctgagagcagatcttcagagaaaaaaaacttgagtgcagtagtttatttggcgtttggctccaggatgcaggagtgggaaagatggtagagagacagaagatctgactgaacaggaggctgaaatatttatccgctggctcctgtttccaattgattgagggatgcccccaaggaagttaacttcactgcaattctgagctgtaattgactttaataagctccaacagcactgaaagacgtttggattattttcagtttgggataatactactatgaacattcctgtacatgtcttttgagaacacgcatgtgtacatttgtgatgggtatgtaatggggtggaattactggttcatagaatatgtgcatattcacctttagatatagaggctgccaaccatttttctgaagtgattatactaatttatattctcactatctgtaaatgaacatttctgttgctccacatccttgctggcacttggtattgattgatttctcttttaattttaggctttttaatacgtgtgtagtgatatctcacttgctgtttgtttgctttttggtaaattttttattgaagtataatttacatacagaaaatcacacaaattgtgtacaggtgtgatttttcacaccgtgaatacatgcaaaaactagtatgaaattaagagttggaacatcaccagtactccagaagccccatgcatgttctcttccagttactataccactatcccaaggatggtctattaattcaacagcatagatttattttgcctgtttttcaacttcaaataaatgaaataatatgcactcttgtgtctggcttctttgactcaacagtatgtctatacaactcatctgtattgttgcatgttgtagttcgttcattcatactgttgtatacagtattgaattgtataaattactcattctgttactatgcatttgggctgtttccagttttggctattatgaataaagctgctatgaacattcta

SEQ ID NO: 426728 - DNA, 3281 bp, Homo sapiens
cactcacctgaatgtgtaaggacatctttcctcaagagcttctcacttcctgaggagtctgtagtcttcattcaaatgtcttgatggctcattttccagaaatctctgtaggtcttgagaagcattgtcctagctttggtttatctgaatagtcctatttaaacttgtcccacacagatagcagcctcttgcttgcccttctgtttgtacacttgtctattttctctttctttaaatgccttttgggtgttaatacttcattggtggttccatagccttgtccccctctcttttgcaacttgaaggcaattctcagttctcttcttgagcacattcatacttagcagcttctgaatatcccacccacaattaaggtacaatctggtcacataactttttccctaggaagaaatgtgctactcaagactaatagccaaggttaagaacgtgcatactcctgaatcggatgtaaatgcattagtctatttgttctgtttagaaataaagatggaacatattttatagctactgttagtgcccatgtgccttctaaatatcttttgaatagttttacttctctccatcttgacagctaccatgccaatccaagcttccatcaccttgctcctggcttactgcagtatcctcctgtctacccttcatccacttttatctctttccaatcacttgttcatacaacagccatattgggtttttttcaaaacacacatataatcagggcacttctcaacttaaaaccatttctggcattacttgcccttaggataatgacaaaactttttaacacagtccacaaggccagagatagcctgacccttgctgatctgtccagcctctgctatatgtccccttattttctctgttccaaccacattggactttgttcctcttactagtcatgctccccacctatttggttccctagttaacttctcttcatccttcgatttcaacttgtgtcacttcctccagaaagcctaccctttctttcttaaccaggccgataggctgtcaaaaccaggaatctcttcttcgtagcactacagtcatactcattgatacgtgtgattattaatgtgggttttttaaaaaattagaatgaaactcaagagcagggaccacatctattacttgtgattaatatattcctagtggttagcacagtgtctagacaaatatatgttgaatgaataaatagaaaagggagaggaaaaagggaaggattgaccctctgtgaggcagtcttgcaaacagcagaaatgcaaagcaaagctgaagaactaactattcaacacacacctagaggagcgttgtaatgtcttgtgcctgtctcaaatgggtgcattcttatgggtaagttttactagtccagctttcactgtaatagttcacattcctctcctagtgtcagtctccaacaaatccctcagtaattcgtaatcagtaatctcatgccaaggatgagagaggggcattatccaaaaagttgggtgtgtccatttttttttgagtcttgctctgttgcccaggctggagtccagtggcatggtcttggcttactgcaacctccgcctcccaggttcaagtaattctgcctcagcctcctgagtagctgggattacaggcgcctgctacctcgcccggcttttttgttgttgttatttttagtagagacggtgtttcaccatgttggtcaggctggtcatgaacttgtgaccttgtgatccgcccgccttggccttccaaagtgctgggattacaggcgtgagccactgtgcccggctgttcatctgtttttcaatacctttaagttcagtttcccttacaaagcccacttttttcttagtgggaatctcttgtaccacttaacacctacattccttaatttttaaagttaaaacacttatatactataaaatggacacatcttaagcatacagcttgatgaagatttacaaagtaaacatgccagttgaaacaccactctgatcaggatgtggaacataaccagcactccagaaatctctctgccatcattaccaccactggttatcctagccactcttctgacttgtatcaccatagataggttttacttgttttgaagccatctataaatggaatcatggaagtttgggcttccctgagagcagatcttcagagaaaaaaaacttgagtgcagtagtttatttggcgtttggctccaggatgcaggagtgggaaagatggtagagagacagaagaaaaatcaatagaaaggtattacggaggttggatatataatgcttcccagaattgtctgactgaacaggaggctgaaatatttatccgctggctcctgtttccaattgattgagggatgcccccaaggaagttaacttcactgcaattctgagctgtaattgactttaataagctccaacagcactgaaagacgtttggattattttcagtttgggataatactactatgaacattcctgtacatgtcttttgagaacacgcatgtgtacatttgtgatgggtatgtaatggggtggaattactggttcatagaatatgtgcatattcacctttagatatagaggctgccaaccatttttctgaagtgattatactaatttatattctcactatctgtaaatgaacatttctgttgctccacatccttgctggcacttggtattgattgatttctcttttaattttaggctttttaatacgtgtgtagtgatatctcacttgctgtttgtttgctttttggtaaattttttattgaagtataatttacatacagaaaatcacacaaattgtgtacaggtgtgatttttcacaccgtgaatacatgcaaaaactagtatgaaattaagagttggaacatcaccagtactccagaagccccatgcatgttctcttccagttactataccactatcccaaggatggtctattaattcaacagcatagatttattttgcctgtttttcaacttcaaataaatgaaataatatgcactcttgtgtctggcttctttgactcaacagtatgtctatacaactcatctgtattgttgcatgttgtagttcgttcattcatactgttgtatacagtattgaattgtataaattactcattctgttactatgcatttgggctgtttccagttttggctattatgaataaagctgctatgaacattctagaattgtcttgttgaacatatgtatttctgctgggtataaagcttaaaaaggaaatta

SEQ ID NO: 426729 - DNA, 1847 bp, Homo sapiens
aggggctgggcggggtcgggctcctgctccggctcagctgcggcggccgcaggttccaaagcgggtccgagccgccgccgcgcgcgcgccgcgcactgcagccccaggccccggccccccacccacgtctgcgttgctgccccgcctgggccaggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagatgtgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaaccttt

SEQ ID NO: 426730 - DNA, 2022 bp, Homo sapiens
aggggctgggcggggtcgggctcctgctccggctcagctgcggcggccgcaggttccaaagcgggtccgagccgccgccgcgcgcgcgccgcgcactgcagccccaggccccggccccccacccacgtctgcgttgctgccccgcctgggccaggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagatgtgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattgatcgatgaattaagtgaggtggaattcttttctttctgctttagcttctctctgttggacttagagctgggtattgctattttagtgtataatcaagctgtggaaataaatttccagcattaatgtcta

SEQ ID NO: 426731 - DNA, 1894 bp, Homo sapiens
aggggctgggcggggtcgggctcctgctccggctcagctgcggcggccgcaggttccaaagcgggtccgagccgccgccgcgcgcgcgccgcgcactgcagccccaggccccggccccccacccacgtctgcgttgctgccccgcctgggccaggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagatgtgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattga

SEQ ID NO: 426732 - DNA, 1781 bp, Homo sapiens
gcgcaggttcaagcgggtcgagcgcggcgcgcgcggcatggccagggcggcctccaccacgtctgcgttgctgccccgcctgggccaggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagatgtgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaaccttt

SEQ ID NO: 426733 - DNA, 1894 bp, Homo sapiens
ggatctcctccgagccccgccctccctcctcacctgctcctggggaaactacaccaaggccgccgctctggcctggggctccctcccacacggccttggccctctccccctcgccccgggaccgctccgcccctcccggatcccggtcggcggagcgcatttatttgcatatttctacctttgttcccccgcctgggccaggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagatgtgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaaccttt

SEQ ID NO: 426734 - DNA, 1401 bp, Homo sapiens
  misc_feature (2)..(2): n is a, c, g, or t
  misc_feature (27)..(27): n is a, c, g, or t
  misc_feature (44)..(44): n is a, c, g, or t
tnccaaatcccttttaaaattgattantccttgttactttgtanttaattgttcaagttttcttgtatccttgcgctttgtttaagcccttgaaccaggaccaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagatgtgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaaccttt

SEQ ID NO: 426735 - DNA, 659 bp, Homo sapiens
gaatcgtagtattgcgattaagggtagtcccacattgctcaagggaaaaggctcattttactaaatatgtctgatggacatagtagtcgccaatatagaacacaagactagcattgaacttgaacatggtatgtcgtatgtcatgcatatacactcgattatgctatttctcagatagataagtgactgttctacaaggtaattttagagtgactaaaattaattgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattga

SEQ ID NO: 426736 - DNA, 307 bp, Homo sapiens
cagaaagcaggttttttcttcttcaaaaccattctacctcattagcattcaagctagctgtggctctgatgatcacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattga

SEQ ID NO: 426737 - DNA, 336 bp, Homo sapiens
aaagatgcaaagcgattgagagggtccaaagttattttattgatcaactgaataaatatacataaatgttactttctttttctttactttatttttttttccccattccagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgttt

SEQ ID NO: 426738 - DNA, 584 bp, Homo sapiens
agttgtgtatataatgctcttcaatatgctcgtgtaactcgtggcagatacccctgagattaagcttatgaggagcttttcaaccagatgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccagatgcggccagccccccttcctttggttccaacactttgtggagttgcg

SEQ ID NO: 426739 - DNA, 2905 bp, Homo sapiens
caaggtggagaagcctcttccaactgcaggcagagcacaggtggccctgctactggctgcagctccagccctgcctccttctctagcatataaacaatccaacagcctcactgaatcactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426740 - DNA, 615 bp, Homo sapiens
atggcccacattctcgaagaccttggggaaaactggattaaaatgatttgccttattctggttctgtaagatacacatcagaatgaaaccacccccagtgtacctctgaattgcttttctattcttttcccttagggatttgagggcttcacttagatttctcttcatctaaactgtgatgccctacattgatctgatttacctaaaatgtctttcctctcctttcagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaagctatgctcttcaccgtgacccaaagtactggacagagcctgagaagttcctccctgaaaggtacaaggcccctgggaagggagccctccctgaaccagcctggttcaagcatatt

SEQ ID NO: 426741 - DNA, 701 bp, Homo sapiens
tcaattgtaaatacactccttgttccccctactctaagaagagctgaaatgactctcttattaaaaccaccagcagtgttctttccttcactttatatgaactggccactcaccctgatgtccagcagaaactgcaaaaggagattgatgcagttttgcccaataagcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggtacaagtctccagggaaatggagctcaccctgacccaggctggttcaagcatattctgcctctcttaatctacatgacaatcgtgtggttgtacaatcatttgcttgtaagtctttttatcacaaaaaagtgataattatcaaactttacaaaccacagactagaaaaaacgaaactacattcattcacagtcccagcacaagacaaagataatcaattatgtccctgtgggcatttttctacgcctatatagatttttaaacaagaaactatccactgacctatattactataaatatacatatat

SEQ ID NO: 426742 - DNA, 1532 bp, Homo sapiens
ggctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggtatctcttccctgtttggaccacattacccttcatcatatgaagccttgggtggctcctgtgtgagactcttgctgtgtgtcacaccctaatgaactagaacctaaggttgctgtgtgtcgtacaactagggaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctctttagctgaggatgaagaatggaagagaatacggtcattgctgtctccaaccttcaccagcggaaaactcaaggagaaaagacatcacaaaattcattacaaaatgtcacttactgctccatgctggagaaagccatatccttctgggacttgagtctgcacatttaactacagcatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggtgaggggatgacccctggagatgaagggaagaggtgaagccttagcaaaaatgcctcctcaccactccccaggagaatttttataaaaagcataatcactgattccttcactgacataatgtaggaagcctctgaggagaaaaacaaagggagaaacatagagaacggttgctactggcagaagcataagatctttgtacaatattgctggccctggttcacctgtttactgttatcacaataatgctaagtaaaaaaaaaaa

SEQ ID NO: 426743 - DNA, 1640 bp, Homo sapiens
ggctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggtatctcttccctgtttggaccacattacccttcatcatatgaagccttgggtggctcctgtgtgagactcttgctgtgtgtcacaccctaatgaactagaacctaaggttgctgtgtgtcgtacaactagggaacgtatgaaggtcaactccctgtgctggccatcacagatcccgacgtgatcagaacagtgctagtgaaagaatgttattctgtcttcacaaatcgaaggatttgtgcaacgaccagcaccatcaagatgcagacccattccgtcaccatgtggctccctcctgctgtcctacagtcacaacatggagtttgtctttttctctgacagtctttaggcccagtgggatttatgaaaagtgccatctctttagctgaggatgaagaatggaagagaatacggtcattgctgtctccaaccttcaccagcggaaaactcaaggagaaaagacatcacaaaattcattacaaaatgtcacttactgctccatgctggagaaagccatatccttctgggacttgagtctgcacatttaactacagcatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggtgaggggatgacccctggagatgaagggaagaggtgaagccttagcaaaaatgcctcctcaccactccccaggagaatttttataaaaagcataatcactgattccttcactgacataatgtaggaagcctctgaggagaaaaacaaagggagaaacatagagaacggttgctactggcagaagcataagatctttgtacaatattgctggccctggttcacctgtttactgttatcacaataatgctaagtaaaaaaaaaaa

SEQ ID NO: 426744 - DNA, 2826 bp, Homo sapiens
  misc_feature (2)..(2): n is a, c, g, or t
angaagaaaaggtggacaaaaaagaggcggtacggtgcggaattcccgggatcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426745 - DNA, 3026 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426746 - DNA, 2874 bp, Homo sapiens
  misc_feature (2)..(2): n is a, c, g, or t
angaagaaaaggtggacaaaaaagaggcggtacggtgcggaattcccgggatcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaattggttttctacagccccaattccttgccttttccaattaattttccttggggaaggaaccaaggaaaaaccaattggttttccccttaaccaacccttccttttggccaattttcccatccctaacacccaactgtctcgatgcaatgaacacttaataaaaaacagtcgattggtcaattgattgagcaataagcct

SEQ ID NO: 426747 - DNA, 2807 bp, Homo sapiens
  misc_feature (2)..(2): n is a, c, g, or t
angaagaaaaggtggacaaaaaagaggcggtacggtgcggaattcccgggatcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426748 - DNA, 2146 bp, Homo sapiens
  misc_feature (2)..(2): n is a, c, g, or t
angaagaaaaggtggacaaaaaagaggcggtacggtgcggaattcccgggatcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccagatgcggccagccccccttcctttggttccaacactttgtggagttgcg

SEQ ID NO: 426749 - DNA, 2150 bp, Homo sapiens
  misc_feature (2)..(2): n is a, c, g, or t
angaagaaaaggtggacaaaaaagaggcggtacggtgcggaattcccgggatcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccagctgcggccgacgttcacgttaatgcctactccccggtcgcccacccccatac

SEQ ID NO: 426750 - DNA, 2138 bp, Homo sapiens
  misc_feature (2)..(2): n is a, c, g, or t
angaagaaaaggtggacaaaaaagaggcggtacggtgcggaattcccgggatcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccaagatgcggccggcccgcaaaattaaataaatcttgacacccgccatccgcgtgccactct

SEQ ID NO: 426751 - DNA, 2151 bp, Homo sapiens
  misc_feature (2)..(2): n is a, c, g, or t
  misc_feature (2111)..(2111): n is a, c, g, or t
  misc_feature (2127)..(2128): n is a, c, g, or t
angaagaaaaggtggacaaaaaagaggcggtacggtgcggaattcccgggatcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccagcgtcggccgaagngcggtttttttttttnnttctcccctcccgcagggcgata

SEQ ID NO: 426752 - DNA, 1785 bp, Homo sapiens
  misc_feature (2)..(2): n is a, c, g, or t
angaagaaaaggtggacaaaaaagaggcggtacggtgcggaattcccgggatcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggg

SEQ ID NO: 426753 - DNA, 2987 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426754 - DNA, 2972 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426755 - DNA, 2087 bp, Homo sapiens
  misc_feature (42)..(43): n is a, c, g, or t
  misc_feature (48)..(48): n is a, c, g, or t
ggtctgtgaacgtttctaatgatgtggataagaggggctagnntgacngactctcttatttaccaccgctaccagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426756 - DNA, 2772 bp, Homo sapiens
  misc_feature (2)..(2): n is a, c, g, or t
angaagaaaaggtggacaaaaaagaggcggtacggtgcggaattcccgggatcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgtctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426757 - DNA, 2933 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426758 - DNA, 2931 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426759 - DNA, 2933 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426760 - DNA, 1892 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaattttcctaaggacttctgctttgctcttcaagaaatctgtgcctgagaacaccagagacctcaaattactttgtgaatagaactctgaaatgaagatgggcttcatccaatggactgcataaataaccggg

SEQ ID NO: 426761 - DNA, 2607 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagtcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426762 - DNA, 3012 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagactagaaaaaagaaaactacagtcatccacaattccaacaacttacgatgaaggtcatcagttatgtccttatgggtcatcagtgtccaaaatattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426763 - DNA, 1773 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggatctaccaacgtggaaccagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggg

SEQ ID NO: 426764 - DNA, 1922 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggacttctactttggtcttcaagaaagctgtgccccagaacaccagagatttcaacttagtcaataaaaccttgaaataaagatgggcttaatctaatgta

SEQ ID NO: 426765 - DNA, 2187 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggacttctactttggtcttcaagaaagctgtgccccagaacaccagagatttcaacttagtcaataaaaccttgaaataaagatgggcttaatctaatgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcaaaaaaatataaaaacttaataagcacaaaaaccttaaaagggaattaaatttacaataaacttgctctcgggaataaaaaatggcatcccttggaaactttgtattaatcccatacggtccgttccttgtctaccttta

SEQ ID NO: 426766 - DNA, 201 bp, Homo sapiens
taagataatcaaaaatatgtatgaccattactattgtaaactaaaatgtttttgtcaatctagagccctcacacactttagctgtcaacaccccaccacaaaccccattgccctaagcatccaataatcaactttctgcctctatagatttgcctattctggacacttcatagaaataatatcattgatttttctctgttg

SEQ ID NO: 426767 - DNA, 406 bp, Homo sapiens
actgctgacatgtagtgtgtggtaaatgtgagtgtttcacagcctggagtgaacaggggtcttctctgagaattgaggttgcaaggctggctaactcagctttgccttcacgagccctagaggccagccgaaggatgtctgcaggtcagggagacaggaccaggtaacccagctgtcactgaagattatatagagtttgagaatgttggaatatttgaaaatgctcccccaaaaaagctgctgatgagttctggaaatgtcaggagattaatctatacggacactgctgaagaaaaaggtagaagaataaaagatccagtacttcttcctgggtaagcagttatgaccagagatggaaccggcaactctttggccagaaagctgtatccaaaagacagagaagatg

SEQ ID NO: 426768 - DNA, 296 bp, Homo sapiens
gagactgggaattccagggcccacacctctgcctttgttgggaaatgttttgtcctatcgtcaggtgagttgcttgagcttcctcttttgcttcttatggttgcaaacatcagcttagttccatcagtaaaaatgcccctccttgggagggagttctgaggtttcacattttcagaaatggtgggactgggtgcagtggatcatgcctgtaatctcagcctctgtgaggccaagactggcaaattgcttgagcccaggagtttgagaacagcctgggcaacacagtgagacacctg

SEQ ID NO: 426769 - DNA, 383 bp, Homo sapiens
tccactgattaaatttttattttgaaaaaaacatatattcacagaaggttacctaaaaaatgtacaggaaggttccatgtactcttcatcctgtcccgcccagtggtaacatcttgcaatcttgtatattgcaatatatatctagtatattcatattatcaggttggcacaaaagttaaaatggcaaactacaggctgggcataatggctcatgcctgtaatcccagcactttgggaggccgaggcaggtggatcacgaggtcaggagttcgagatcagcctgaccaacatggtgaaaccccatctctactaaaaatacaaaaattagctgcgtgtggtggcatgcgcctgtagtcccagctactcagtagtctgagacagga

SEQ ID NO: 426770 - DNA, 2648 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaactttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426771 - DNA, 1748 bp, Homo sapiens
  misc_feature (42)..(43): n is a, c, g, or t
  misc_feature (48)..(48): n is a, c, g, or t
ggtctgtgaacgtttctaatgatgtggataagaggggctagnntgacngactctcttatttaccaccgctaccagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaactttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 426772 - DNA, 1868 bp, Homo sapiens
agaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctaaaaaaaaaaaaaaaaaaaaaaaaaaaaaaaaaaaaaaaaaaaaaaaaaaaaaaaaaaaaaacctcgtgccgaattcggcaccaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaattatctttatttttgctggctatgaaaccacgagcagtgttctctccttcattatgtatgaactggccactcaccctgatgtccagcagaaactgcaggaggaaattgatgcagttttacccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggacttctactttggtcttcaagaaagctgtgccccagaacaccagagatttcaacttagtcaataaaaccttgaaataaagatgggcttaatctaatgta

SEQ ID NO: 426773 - DNA, 401 bp, Homo sapiens
agaagataagataattgaagagcttgggaaaataggttgggggagggagcagaaatatttgtgatcttactagctaacagaattgctgcttggtttattactaaaagggttttatttctcaagtctttctgtttgcttttcattctccaggtaagaagcgcaattccacactctacataaccatgttactcattgttccagtcatcgtcgcaggtgcaatcatagtactcctgctttacctaaaaaggtaaggtagctgccctggcaggttttgcagtttctgatagcctgtttgctgtggttattacttttagtgcttgtgttttatgtctgcccagtgtattagaagcatgttgcctgtaagtggctttcgggagtatgacatgacaaggaagtattac

SEQ ID NO: 426774 - DNA, 4012 bp, Homo sapiens
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtca

SEQ ID NO: 426775 - DNA, 4045 bp, Homo sapiens
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcaagcgggccgccaccgcggtggaaactccagctt

SEQ ID NO: 426776 - DNA, 1109 bp, Homo sapiens
  misc_feature (1108)..(1109): n is a, c, g, or t
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtaaggttttaaaattattgtttttatttggctatttttcttttacttgaatttcttacattgaaatatcaatgaaacatagctcttacatttgtcaccttatgatgatgatggtaatgaaacttcttgtctaaaataaggcatggtggaagatttgaagatttatggtatgatagtatcagctgcaagtttcaagccatttattcatctgtaagcttcttagaaaggccnn

SEQ ID NO: 426777 - DNA, 667 bp, Homo sapiens
ctgattacggggagtgtggcgacgtcagctaaatactttgacgccggtggggatagcgatgattatggtagcggagaatgtttggagaccagaatgatgatactctggaaacaaaccatcaggcctcccagaaagtatccgggatctgaaaatcaccaaatcaccacatccggacagtgagaagccagatccctcacccttcttgattggctgacaaaccaactgcttcctgttgaccaactcctcttccttatccctccctaattcctgttttcccacacatggtttcacttcttccctgctatacaaacacctaattttagttggtcagggagatggaattgagactgatctcttgtctccttggctgctgcacctgattaaagccttcttccttggcaatactcattgtctcagtgtttgcctttctgtgcagtgagaaaacaggacctagatggaactcctgctgttttggtaacattactacagacctctcagaatggctaaaataaaaataatgacaacacctcaataatagtaaggatgcaaagaaatcatatcactcatatatttcttgtgggtacataaaatggtacagctactctgagaaagagtggcagtttgtttaaaaacgaaacatgcaactatcacatggtccagcaattgt

SEQ ID NO: 426778 - DNA, 3958 bp, Homo sapiens
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaacttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtca

SEQ ID NO: 426779 - DNA, 4691 bp, Homo sapiens
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcacccaaatgttttcctttggtcttattttggggaaatggtgggaggtagagaaaattggagttaaaagaagaaacattatgaaaaaattccaagccagctattttatcttataatcattcatcatgagtttctttgatgttctggctgttccggtgtgcctatgttttctgataagggcataaatacacttagtttaatattaatttagcctttgtaagcagcacttgaagggacttaagtattcaataaattgtagttatgataattaatggaaatggagggttggtcctttctaatattaagctaaagtggaatgcaatatgattaatgatatacatgatgtgcaatgtctagtcacaagggaatatattagcaggttagattagagaccaagaaagtcagtttttgactggacgcagtggctcacgcctgtaatcccagcactttggaaggctgaagcgggctgatcatgaggtcaggagatccagaccatcctggctaacacggtgaaaccccagctgtactaaaaatacaaaaaaattagctgggtgtagtggcgggcgactgtggtcccagctactcaggaggctgaggcaggagaatggcgtgaacccgggaggtggagcttgcagcatgccactgcactccagcctgggcaacagagcgagactccgtctca

SEQ ID NO: 426780 - DNA, 3958 bp, Homo sapiens
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatactttcccttcatctgggcactgaagggatatgtgaaacaatgttaacatttttggtagtcttcaaccagggattgtttctgtttaacttcttataggaaagcttgagtaaaataaatattgtctttttgtatgtca

SEQ ID NO: 426781 - DNA, 3673 bp, Homo sapiens
  misc_feature (3590)..(3590): n is a, c, g, or t
  misc_feature (3595)..(3595): n is a, c, g, or t
  misc_feature (3665)..(3665): n is a, c, g, or t
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacatttggaatgctgaacaagtncatgncaagtcttgggggaattggggggaaattgaatcttttttggtttccccaattccctccttcctttttaanccaagtta

SEQ ID NO: 426782 - DNA, 4117 bp, Homo sapiens
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtggtccaacctctccatactgccacattggggatgaagtttcaacatgagtttgggagaagataaacattcaaatcatagcaggaacccaggccatctgactctaagtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtca

SEQ ID NO: 426783 - DNA, 2383 bp, Homo sapiens
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaagaaaagaaaaaaaaagaagaagaggggggggggcctagaatcaaatattctatacgaaggcgggggggagtagtaaaatgatgcacgacctcttatttgttagtagaaagatgaggaggcactgtagattgtggatgaagagtgatttataaatatagaataagggcagacgggggtgtaatttataaataagaacgtgagtgggggaggaaacaagatgacctaagtgtaggtgtacgtttgtgtaataagaagaaacatacaaatgttggagggggggaataatgatataaggaataagacactatcgaaagaatataaatactagtggagggagagtaataatacagggtgatgtgatgtagtgagaaaaagcactatttatggcggaggaagatggtggtataggaagataatataaaaaaatataaggga

SEQ ID NO: 426784 - DNA, 2060 bp, Homo sapiens
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctccccaactcatcgccttaccacgctaatcctactatctccccttttatactaataatcttataagagaaaaaccagcacacccgacacaacgacaacacaacaga

SEQ ID NO: 426785 - DNA, 1800 bp, Homo sapiens
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctggaaacaaaccatcaggcctcccagaaagtatccgggatctgaaaatcaccaaatcaccacatccggacagtgagaagccagatccctcacccttcttgattggctgacaaaccaactgcttcctgttgaccaactcctcttccttatccctccctaattcctgttttcccacacatggtttcacttcttccctgctatacaaacacctaattttagttggtcagggagatggaattgagactgatctcttgtctccttggctgctgcacctgattaaagccttcttccttggcaatactcattgtctcagtgtttgcctttctgtgcagtgagaaaacaggacctagatggaactcctgctgttttggtaacattactacagacctctcagaatggctaaaataaaaataatgacaacacctcaataatagtaaggatgcaaagaaatcatatcactcatatatttcttgtgggtacataaaatggtacagctactctgagaaagagtggcagtttgtttaaaaacgaaacatgcaactatcacatggtccagcaattgt

SEQ ID NO: 426786 - DNA, 1474 bp, Homo sapiens
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgccctggaagaaaataagcttaattaggctcagagaggtgaagctacttgttcaaggtcacacaatccattcatttttctccttgattctaccttagtccaagaaaccatcataccttgtccagactgctgctaacagctgcctaaatagtcaccatgccttcagtttggtgtctactttaatccattgtccaccttacacttccagaaacatctatttaaaacaccatcttcca

SEQ ID NO: 426787 - DNA, 614 bp, Homo sapiens
aaccattaaaaatactgttgataaattcatttttttttgtccttgatttgaacagaaactcagccacctgtgacaaatttgagtgtctctgttgaaaacctctgcacagtaatatggacatggaatccacccgagggagccagctcaaattgtagtctatggtattttagtcattttggcgacaaacaagataaggtaagttttctgcaacatgttacattgatgaggtaaagtgaacactatgaattggagccaagaataagccaaattctagtcttacgtcaaagtggaaattgtattttagggtgtgtttaaatttcagttggggaaattatagaagcaactattgacacaagtgaacacttaaaaatatttgctaattatttgacaattaaatgcaattgagattgctctgacaggaaatactagatatctttttctctaaggtactcaataaataattatgttattgttaaaatttgttcctatgttcctgcctgtagctgtattgccttgtatctatataacacttaattttggggaatttttacatttaccatcttgctaatcacatggacaaatagatgtacaggcactatgtggtgtaaaagtaa

SEQ ID NO: 426788 - DNA, 1503 bp, Homo sapiens
ggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagagaacagaatttttattaaaatttaaaacactgatgtataaaaactaagctgaagcagaaaatagactggggaaagggactgtcatgctctcttgatgtcaggaaaagagtacttacaattgaaatttattttcttcttaatcactttcaaaccacccagggttaattgacagtatacagttatttagaaaaccataatccaaatggttttatgttcttttctatctcatttccatttttattaacaaactgaacaaaaatatagaaagcaggcataggctgcacacagtgactcacgcctgtgatcccagcactttgagaggctgaggcaggaggatcgcttgagcccaggagttggagaccagcctgagcaacatggtgaaaccccatctctacaaaaaatacaaaaattaaccagatatggtggtgcacgcttgtgg

SEQ ID NO: 426789 - DNA, 846 bp, Homo sapiens
ggcctcccaaagtgataggattacaggtgtgagccaccatgcccagtcactttttacatttttaaaacctgagcacaggccttgaaattataccaaggtttaaattctaggtctgatgtatgacatggccaagttagttattgtgaattttagttttcttatttatgaaatggggattgtaatactgagttggtaggattgtgaggattaaatcagaatatataaaagtgtcttgcataatgtgacacatgaataaatggtcgtttatttttctaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattggtaagtagactttgctttcatcctaagaaacataaagggaaaaggatctcaatagtgtttcaatttttgtaagttaaattataaatttggaagatagcccgcgactttaaataaggttaaagaatcagacatttttaatatacgtatttaaatttgaatttaggaacaaacttatattttgactgctaaaaccgagtattgtagttgatattttgcccctttagaacattgtttttgagaaataagatggaaagcattataaatttgaatacttagttatgtattgttagatagcgtttatgctacttctgaattgaaatggttcatgaacttttgtaatctttggtttaaatttacattctctgtttttaaatggaaaatactttcattgtaat

SEQ ID NO: 426790 - DNA, 3729 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacata

SEQ ID NO: 426791 - DNA, 4888 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacataaaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagc

SEQ ID NO: 426792 - DNA, 3189 bp, Homo sapiens
aaaaactgcttctctgcatggggtttatgagttgagacagacatttatgtgaaagagataacaacagagggaggagcaagtcttcaatatcaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacata

SEQ ID NO: 426793 - DNA, 2996 bp, Homo sapiens
ggcctcccaaagtgataggattacaggtgtgagccaccatgcccagtcactttttacatttttaaaacctgagcacaggccttgaaattataccaaggtttaaattctaggtctgatgtatgacatggccaagttagttattgtgaattttagttttcttatttatgaaatggggattgtaatactgagttggtaggattgtgaggattaaatcagaatatataaaagtgtcttgcataatgtgacacatgaataaatggtcgtttatttttctaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacata

SEQ ID NO: 426794 - DNA, 2964 bp, Homo sapiens
taacataatacctccagttctatccatgttgtctcaagtgactgaatcgcattttttttatggctgaatagtactccactgtgtataagtcaagcataaagaattttaagcataccggaataatacaggaagttcccccattgtactcattcctcagtttcagccattatcaagtaatgaccaatcttgtttcattcatactcactctctttttcaaatttgagagtcagattgattgataaaatatatctcatgctgttaccgctgaataaatgacttttgctggtaaagtagtatgcttttaaaataatatgaaaaaattctgaattaaggttagtaatttacactgtaattgattttaggtgttattatattacttgctaataagatttttttttctgggaatagaagcttataaaaatttaaaatatgtttaattttctatatagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacata

SEQ ID NO: 426795 - DNA, 2838 bp, Homo sapiens
gtttgtctcagtgggtattaaaggttgggagactgcaatgataagtgtgtctgaatctctctatggggctgtttgtgagggggttcaaattctgagtgctcatcacacacctcccctattctaaaattattgatgcactgttattgatgggattgtacgggttgatagcctttctatagtgactgtagggctgtattcagccttgtagatccccctagtggtggttttgtaaaggctgtcttcagtgtcttatttcctcagaaaacaactggtatttctcacagctccttctagatttggacaaaggaatgatacaagagcagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacata

SEQ ID NO: 426796 - DNA, 3217 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtgtcgaacttgatgaaatcagtaatcttgccagtcactaaatcaatctgaatggtatcattcaccttgtttgtccaaaggtcag

SEQ ID NO: 426797 - DNA, 1044 bp, Homo sapiens
gttaattcacctatgttattttgagaacttctctgcctttaaaatcagcaatactggattattctgtagaatgatatacatatcgatgttctgcagataaaaggctctaagacgaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacata

SEQ ID NO: 426798 - DNA, 2272 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggttagttacaattttatttgaatattttagacttaaagctctatttgttgtcaaaagaattgaaatctgggtggaaggaatggaaaaatgttttatatattaaataataagaaattgtgtttaagtataaaaaacacattttctgagggcatttattgacattatcagtaatctagttttatcgttgccaatttgttacatttt

SEQ ID NO: 426799 - DNA, 1802 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcagatggggctaacagagctggggtgctgcccacgcgtccgtctaaatgtccttttatgctattatcttctgcatgcaaactttacatacatcagcatgaatatccaacattcactgaacacagtgccaccagcacttgtaattgcttttcagaaataatgcttctcataattgtttataacgagcatcaaactatccc

SEQ ID NO: 426800 - DNA, 1564 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcaccccagctctgttagccccatctgagtctaatgctaccagcactgccaacttttccgg

SEQ ID NO: 426801 - DNA, 1091 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggttagtcttataagagtttttccttcctccctccctgcctccctcccttacttcagcctgggccacagtgaaactctgtctc

SEQ ID NO: 426802 - DNA, 850 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcctggcatgtctagtccgacctgaccgagcagatactggactgcggccccagagggtcggtgcgggagctacacgagctgccctcggacaacgactatttcaaggtgggggcgcccggttagaaagggaggccgcaggggtcgccggctgtcacagtcccgcgggcctgaggcaccagccggccctacttcctactgaacaatccggagaaaggggcccaagccctctggggaccactctgaggtggatctggggctccctcattccccccgccccctctcaactttatttgggaagcgcgctcctgaaaaagaccttggaactggctacagggccctaacctgggagcggggacttgagaaagctttggagcgttctgggaggcgttgctgaggtgggggtggg

SEQ ID NO: 426803 - DNA, 3451 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacata

SEQ ID NO: 426804 - DNA, 3675 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacata

SEQ ID NO: 426805 - DNA, 2885 bp, Homo sapiens
gctggacacattttccagccattcggtttttgcctgccttatgtatttaggtgattattcttctaggtttatcaagaaactgaggagtacctttttaggattgttgctggaggctgttgaaacatagactagcttcaaatttgagagtcagattgattgataaaatatatctcatgctgttaccgctgaataaatgacttttgctggtaaagtagtatgcttttaaaataatatgaaaaaattctgaattaaggttagtaatttacactgtaattgattttaggtgttattatattacttgctaataagatttttttttctgggaatagaagcttataaaaatttaaaatatgtttaattttctatatagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacata

SEQ ID NO: 426806 - DNA, 2281 bp, Homo sapiens
acacctatcctgtacaaagacgcaaaatatcacagagagctcagccaggacagcagcagaatggaataaactagagtacaacaactacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacata

SEQ ID NO: 426807 - DNA, 2835 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaacatcgatatgtatatcattctacagaataatatac

SEQ ID NO: 426808 - DNA, 1699 bp, Homo sapiens
  misc_feature (1696)..(1696): n is a, c, g, or t
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgtctttcgccagaactcgggaccgagctcggaatccgaaccatccaaaagctgttccgggngga

SEQ ID NO: 426809 - DNA, 1579 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattggtaagtagactttgctttcatcctaagaaacataaagggaaaaggatctcaatagtgtttcaatttttgtaagttaaattataaatttggaagatagcccgcgactttaaataaggttaaagaatcagacatttttaatatacgtatttaaatttgaatttaggaacaaacttatattttgactgctaaaaccgagtattgtagttgatattttgcccctttagaacattgtttttgagaaataagatggaaagcattataaatttgaatacttagttatgtattgttagatagcgtttatgctacttctgaattgaaatggttcatgaacttttgtaatctttggtttaaatttacattctctgtttttaaatggaaaatactttcattgtaat

SEQ ID NO: 426810 - DNA, 1248 bp, Homo sapiens
gcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggttagtcttataagagtttttctataccctctatggtggcagatttaaaaacttgctacgtttcctttcaagctactacagggtaatttaatttgtgctccatctcttcagatactgtgcatcctgtacaaatatgcattatgggaatttctggaagaatatgcaaaagataaaatcttaaagttttttaatgttctactcagaaaaatgttcaatggagaaaatttggaaaataaaaa

SEQ ID NO: 426811 - DNA, 746 bp, Homo sapiens
gaacatttgcagttcctcgtatttattcacaatcccacgaaatcaatggctcttcggtgcactgcaccggagactttcagctcagccgagctgctgttgagggtgataaattataggcgaaagcccggggacatgaaggcaagtcgctgggtttcagactgcctgattgcaaagaggtgacagtgtccttgccccgccgggcgacctaatgcgtacaagaccggggctggcctggtaagtggtgactcttagcctgttctctttgcttcttcctcctccccctgggagaggccgctgaggatccggaagcaggaatgtctgctgtgggtgagcctctgttctcttttgaacaagagaggctaggccctctgagcagccgcactttctcaatggcaggtaagtgcctcctcttggcgttccctgcccctcgcatgttctgcctccgaggtacttgatgttcctggtgaaatgccattttccccaagttgagagtgacctttcattccacagcctcatttccattccagccctccctatcccggctctggatgagaagttcctgttgatttgcagagattctttataagcacagttcaggccagtgcagtcctctggaggagaggctcagcccggcagctctggcaggcccaagtcagccagggtgcagaccggtcctcgagtttctgtgggtctaagagacggtcagcgttggaggaaataatcatttgctaatgcgagcggttttc

SEQ ID NO: 426812 - DNA, 726 bp, Homo sapiens
attcggcacagtgtgaatctgctccgtgcgggccgatctttgtgttcgagccaccgccagggtgaaggccaacacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgccgtg

SEQ ID NO: 426813 - DNA, 4339 bp, Homo sapiens
gaacatttgcagttcctcgtatttattcacaatcccacgaaatcaatggctcttcggtgcactgcaccggagactttcagctcagccgagctgctgttgagggtgataaattataggcgaaagcccggggacatgaaggcaagtcgctgggtttcagactgcctgattgcaaagaggtgacagtgtccttgccccgccgggcgacctaatgcgtacaagaccggggctggcctggtaagtggtgactcttagcctgttctctttgcttcttcctcctccccctgggagaggccgctgaggatccggaagcaggaatgtctgctgtgggtgagcctctgttctcttttgaacaagagaggctaggccctctgagcagccgcactttctcaatggcagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaaggtaccgagcctccccttctgttctccgtggcgcccgctcccattttgccacatcgacaggagaaagtcattgctcttttattttttttttttagttctcgtttgtttccgggccattgtatcttgaaggccttgcacattccatttggcattatttttaaaaattgttttgctacttgcttttttactttcaaaaagttttttttgttcattttataaatgatacatgcatatattctccttaaaaagggggcagaaagttttacataaaagtctgttatcccgtttaccttccatttcattctcttcccttccacagtggccagtatcaaccgttgtaaaagcttttctatgcatgtatgcatgtatatgtatatatacatatctgtatgtatatatgtgcgcatcatgtatatgatgccataaaattagtcctttttcccccctttttttcttttttaaaacataaaaatggtaccatacttgcttttttcccccacccatcagcatgttttggaggtccatccacatcagcacatacagccctgccttgttcttttggactgctgcatagtatttcatagtttatttaaagcattcctctactaatgggcatttaggttgctttcagttttttttctactgtgagcagtgctgcaatgaatatctttgtataaatttccttgtgcacatgagggaacctcttggagttattttggaaaaagtacagtgcgagaagttgatagcgaaggttaccttagtaactggagattcgtcacacacacaagatgagccagcctcaagaaccacttgctgaagttgcagaatcagaactcccaccagtcctgcaggaggctccatctggagctgaaattaggccaaacacagtgctgatctgactggttggtaccagtttgcctggcttttgtgagcattgatgtagatctttctaccaggaaacctgcatctagatcctcaaaggctgggttcttcaactgaaactcatagtgaatgcgcccctgtgaggggggctcatgagcagcagaatgtgaggttgaaaggtggccaggtcttgaattggcccccagtgaaacccttcacagatggcgagggagtgggtcctgaagaattggccaggcaaaattgagagtacagttggattaatcttgctatttaaaaagttggtggggcaaagccgagtctaggatatttgagattgggattgcggcttcctgtcttctgtcttcatatctcataagcaggagacttccccaggggagtttaattgctaccaagaagagggtcgggcgtggtggctcacacctgtaatcccagcactttgggaggccaaggcaggcagatcacttgaggccaggagttcaagaccagcccagtcaacatggtgaaaccccatctctactaaaatggaaaaaaaaaaa

SEQ ID NO: 426814 - DNA, 153 bp, Homo sapiens
tcaaagagtgcatttttatagggttatagatctcaaaaataaaagcattctttagtcggggtgttgtaggttaaaaagaagcatcttgggaaatgaatagaagaacactaattgatttggcaaatgactgctacaaaaattatgtggggacac

SEQ ID NO: 426815 - DNA, 5177 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgccgtg

SEQ ID NO: 426816 - DNA, 5541 bp, Homo sapiens
gccccgaacacgtcgtggctgtgtagaaagaggtagacatgggagacttttcatttggtctttgtgaaagagattttatgaggcttcccaaaatgaagcagttattcacttttaccttcagggtgctttcacaaatgagctactggagtatttttcgtatctttggttgatgaaaaggctcatctccaaacttaatggttgtaccaaggtgttttcattccttcaacaagtcactgagtgctttcttggaacacacagccttgcactgggggttatggggagggaggaagaggctggacagggttactgcatactgccggaaggagattctcatttggctgcagagtgtcgcacaaagtgactccctaaaggcgtctgaaaccaaaagcattttgaggattgttacaagacaccgtgcctggccctcctaatctgtttttttaagaaaagtgaaaaatctaggttattacatgaaatttcctgatttttgtatcttggcaacaagttaagattttacaaaaatgttacataggtcaaagaaatacttgtctgactgttgaagcagacagtgaagaagggggcacgtatattctgggaggaggaacactgaagtggcttcgggagttgggggacagaatgcactctgttcccacacttggttcctccacacctcctccctgtggggcccaggcctccctgactgctttaaaacctgtggtcctgtatctctttcagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426817 - DNA, 5000 bp, Homo sapiens
tcgaatcgtaaccgttcgtacgagaatcgctgtcctctccttgctcgagatccattgtgctctaaagatcaggtgtgggtttcctcccccagccctggataaggatgagggaatgtctttaagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426818 - DNA, 5202 bp, Homo sapiens
gaacatttgcagttcctcgtatttattcacaatcccacgaaatcaatggctcttcggtgcactgcaccggagactttcagctcagccgagctgctgttgagggtgataaattataggcgaaagcccggggacatgaaggcaagtcgctgggtttcagactgcctgattgcaaagaggtgacagtgtccttgccccgccgggcgacctaatgcgtacaagaccggggctggcctggtaagtggtgactcttagcctgttctctttgcttcttcctcctccccctgggagaggccgctgaggatccggaagcaggaatgtctgctgtgggtgagcctctgttctcttttgaacaagagaggctaggccctctgagcagccgcactttctcaatggcagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426819 - DNA, 5166 bp, Homo sapiens
gaactaatgttaccttttatccttgttttcattttcctgtcccttttatacattgtatcctcctctcttctcctgtgtcatggagtgtagaggaaataaaatcatgtctgtggctcatgacagcattccatattcagttgttgggttgtgttgttgttgttgtgtgtgtttttaataataccatgtaactgtttaaaaaaatttcctttttgatcaagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426820 - DNA, 3354 bp, Homo sapiens
tcatagatttaggggaagaccattctgggcgggagggtcgaaaaaataagaaggaacccaaagaaccatctcccaaacaggatgatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426821 - DNA, 5304 bp, Homo sapiens
gaactaatgttaccttttatccttgttttcattttcctgtcccttttatacattgtatcctcctctcttctcctgtgtcatggagtgtagaggaaataaaatcatgtctgtggctcatgacagcattccatattcagttgttgggttgtgttgttgttgttgtgtgtgtttttaataataccatgtaactgtttaaaaaaatttcctttttgatcaagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426822 - DNA, 6233 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaaggtaccgagcctccccttctgttctccgtggcgcccgctcccattttgccacatcgacaggagaaagtcattgctcttttattttttttttttagttctcgtttgtttccgggccattgtatcttgaaggccttgcacattccatttggcattatttttaaaaattgttttgctacttgcttttttactttcaaaaagttttttttgttcattttataaatgatacatgcatatattctccttaaaaagggggcagaaagttttacataaaagtctgttatcccgtttaccttccatttcattctcttcccttccacagtggccagtatcaaccgttgtaaaagcttttctatgcatgtatgcatgtatatgtatatatacatatctgtatgtatatatgtgcgcatcatgtatatgatgccataaaattagtcctttttcccccctttttttcttttttaaaacataaaaatggtaccatacttgcttttttcccccacccatcagcatgttttggaggtccatccacatcagcacatacagccctgccttgttcttttggactgctgcatagtatttcatagtttatttaaagcattcctctactaatgggcatttaggttgctttcagttttttttctactgtgagcagtgctgcaatgaatatctttgtataaatttccttgtgcacatgagggaacctcttggagttattttggaaaaagtacagtgcgagaagttgatagcgaaggttaccttagtaactggagattcgtcacacacacaagatgagccagcctcaagaaccacttgctgaagttgcagaatcagaactcccaccagtcctgcaggaggctccatctggagctgaaattaggccaaacacagtgctgatctgactgctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426823 - DNA, 5056 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagtcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426824 - DNA, 3889 bp, Homo sapiens
gagaatgtactcctccagcgcggtgtgcttggcacgtcgaattggttcggcattcctggctttcataggttttacccagaacttggtggcgtcaagaccgtgcaggtgaacctgagtgaaatccggtttttgtttgttttttcttcatgcattggctagttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaaggtaccgagcctccccttctgttctccgtggcgcccgctcccattttgccacatcgacaggagaaagtcattgctcttttattttttttttttagttctcgtttgtttccgggccattgtatcttgaaggccttgcacattccatttggcattatttttaaaaattgttttgctacttgcttttttactttcaaaaagttttttttgttcattttataaatgatacatgcatatattctccttaaaaagggggcagaaagttttacataaaagtctgttatcccgtttaccttccatttcattctcttcccttccacagtggccagtatcaaccgttgtaaaagcttttctatgcatgtatgcatgtatatgtatatatacatatctgtatgtatatatgtgcgcatcatgtatatgatgccataaaattagtcctttttcccccctttttttcttttttaaaacataaaaatggtaccatacttgcttttttcccccacccatcagcatgttttggaggtccatccacatcagcacatacagccctgccttgttcttttggactgctgcatagtatttcatagtttatttaaagcattcctctactaatgggcatttaggttgctttcagttttttttctactgtgagcagtgctgcaatgaatatctttgtataaatttccttgtgcacatgagggaacctcttggagttattttggaaaaagtacagtgcgagaagttgatagcgaaggttaccttagtaactggagattcgtcacacacacaagatgagccagcctcaagaaccacttgctgaagttgcagaatcagaactcccaccagtcctgcaggaggctccatctggagctgaaattaggccaaacacagtgctgatctgactgctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426825 - DNA, 2654 bp, Homo sapiens
ctgtcaatgtttgctcaagtctttccaggccaaggttagggcctagttgagaaacctggatagagtttggtcaaggggagcatctttgtcatttaaaagtagaaaagctctcaggatgtctattaggggctttgcttctacaccacagctttgtgctgggatgggtccttcccacgtggggtaatcaggatgctttgccttcctagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426826 - DNA, 2195 bp, Homo sapiens
accatgatgaatgccctatttacagatgaagactcgggctaggttattgcccatgggcacacagccagggcttctcccagccaggtcttgcatccacgtctgcctgaatctgggggcaggaataaccccacaccccaggctggggtcaggtgatgagcggtgttcttcccctcctccaccagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426827 - DNA, 2187 bp, Homo sapiens
  misc_feature (25)..(25): n is a, c, g, or t
acccggtgtttatcgatgcaccacngacatcctaggtcttattctgattctgaattcttcagtcacccataagcttgtccttaccgggagtcagtgggtgtgtgttcccaggtggacttaaccattcttctcctttatgatcctttcccttgggtggacaagtgtgatttggttgtaaggccatttttcaagttgcctatacattgataaaagaaatcccactaacggaagtagactgcatgccaaatttcagtgtctttctccaggggccaaggttggacccagaagtgcatggggtgcttggtgtcgttcagtgatgtagtaaggatacacggttccagacacggcacaagaaatgccttccttggcagttcagcaccttttctacaaatctttattctctgtgagcatgacaccctaccgttttttcaaccggttgtcgttaaatcctaaaaaataagttgttctacctttctgttctacagacccacagatgcagggcagtcagcggtggcagtgtttgaaccatcaattgggaggggaaggtggtttcctgtgcaggaggggcaggtcagattgcaggatagttgtgctcaggcgcaggtgggcaggcacgctaaacacattggttttccccctcagaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426828 - DNA, 3770 bp, Homo sapiens
  misc_feature (3572)..(3573): n is a, c, g, or t
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcannaggtgtgcaaggcactgggtttggccaacaacaggacacagaggagccattaaaccggcggaatacctccgggtataacccgtgggaccggttgaaagggtcacttcctacaacaatgaaaaacccgaaaatgggggaccttggctcagttgggaaaacccccgggaacccgggaaaaaaaggagacttcaaaacgg

SEQ ID NO: 426829 - DNA, 2836 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatggtaagtgattgtatctgtttccagttttcttaatttggtttagaatcctacctcgtacacttactatcaaaagttatgtgacccttaaagaaacaaatcagaagttatgtgaccctctaacacactgagagagaggcacagtgaagctgtgtttggtttaaggttgcctagctagtcatagaacaggacctggactcaaacatgggcctgcctacctttaacctgctcggtatccagtatgattgattttgagtacagaaagagaagtctgttagaaaatgatggttacttttagtgaccaagtcatttttagtctgagcagcttcttttcca

SEQ ID NO: 426830 - DNA, 1715 bp, Homo sapiens
gccccgaacacgtcgtggctgtgtagaaagaggtagacatgggagacttttcatttggtctttgtgaaagagattttatgaggcttcccaaaatgaagcagttattcacttttaccttcagggtgctttcacaaatgagctactggagtatttttcgtatctttggttgatgaaaaggctcatctccaaacttaatggttgtaccaaggtgttttcattccttcaacaagtcactgagtgctttcttggaacacacagccttgcactgggggttatggggagggaggaagaggctggacagggttactgcatactgccggaaggagattctcatttggctgcagagtgtcgcacaaagtgactccctaaaggcgtctgaaaccaaaagcattttgaggattgttacaagacaccgtgcctggccctcctaatctgtttttttaagaaaagtgaaaaatctaggttattacatgaaatttcctgatttttgtatcttggcaacaagttaagattttacaaaaatgttacataggtcaaagaaatacttgtctgactgttgaagcagacagtgaagaagggggcacgtatattctgggaggaggaacactgaagtggcttcgggagttgggggacagaatgcactctgttcccacacttggttcctccacacctcctccctgtggggcccaggcctccctgactgctttaaaacctgtggtcctgtatctctttcagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgaggttagttcctgatgaatgaatgcattacctgcctcgtttcctctcctttctctttcttccttttatttttaaatttacaaataatccagatagatggaaaagagaaatttcttgctttccacctgttctatcctggtcacccccttcttgaccaacaccggcagtggctgcagtactgcagctcttggaaagacaattgcacggaatattatttctgatttctcatgagtccttggattccttggagatctgtagtcgtcatctctgcatcttctatgatgaactttttgaaagttaactcccaaatcatgaacggctcacacattttgaaaagatctcattctgttttctccgtcttggatgttgttgcctgccgcatcattgaatcatcagcagtagccaagctgagaagaccacgtttggttgcatgttccctgtagtggccgtctggtgctttcttttgtgcaacaagtatttcttgagtgcctattaggtgctgggaattcgacagtgcacaaaaacaggcatggatcatttttttttttccagcagaaaaggacaaaaaccaaaataaataaagttccatataatgaattaaaagaaaaatgctgt

SEQ ID NO: 426831 - DNA, 410 bp, Homo sapiens
tcgaatcgtaaccgttcgtacgagaatcgctgtcctctccttgctcgagatccattgtgctctaaagatcagtttgaaactcgcagggctgcttaaacaagagctacagctattgaacaaactgctaccattttagcttcaacacaggaatgaggcagtgttgccagacgccattttaagaatcctgcataaatagcttagctaccgatgactctgcctgttttagcttggctgaagaggaaataaaaacagaacaggaggtggtagagggcatggatatctctactcgctccaaagatcctggctctgcagagagaacagcccagaaaagaaagttccccagccaattccaccacactggcggccgcaaggaaaggacagcgattctcgtacgaacggttacaattcga

SEQ ID NO: 426832 - DNA, 419 bp, Homo sapiens
aaaaggaaatgtagagcttgctgggatgccggggccagtgtttgcatttagttcaaaatttagcaaattaggacaaacacaatttatgcgtttattcacaagcctggagtagactcctgaatatcttctaattgagggattggtacttttcatttggtctttgtgaaagagattttatgaggcttcccaaaatgaagcagttattcacttttaccttcagggtgctttcacaaatgagctactggagtatttttcgtatctttggttgatgaaaaggctcatctccaaacttaatggttgtaccaaggtgttttcattccttcaacaagtcactgagtgctttcttggaacacacagccttgcactgggggttatggggagggaggaagaggctggacagggttactgcatactgccgg

SEQ ID NO: 426833 - DNA, 483 bp, Homo sapiens
tctagcagagctgcagatctgggctgggctgttggctaaagtgctcttcacagacacctcattcggctcttccttcagcttcttcacttatttcttactcagtcactactcagctccttgtccatgtgtccttgaagccatcctaggtcttattctgattctgaattcttcagtcacccataagcttgtccttaccgggagtcagtgggtgtgtgttcccaggtggacttaaccattcttctcctttatgatcctttcccttgggtggacaagtgtgatttggttgtaaggccatttttcaagttgcctatacattgataaaagaaatcccactaacggaagtagactgcatgccaaatttcagtgtctttctccaggggccaaggttggacccagaagtgcatggggtgcttggtgtcgttcagtgatgtagtaaggatacacggttccagacacggcacaagaaatgccttccttggcagt

SEQ ID NO: 426834 - DNA, 413 bp, Homo sapiens
gtttattggaagaagctacatgataaatgacagctactataagatgagaaaattccagttattgtgttaaattcaaagagtgcatttttatagggttatagatctcaaaaataaaagcattctttagtcggggtgttgtaggttaaaaagaagcatcttgggaaatgaatagaagaacactaattgatttggcaaatgactgctacaaaaattatgtggggacacaagagtcactgactgtggcttgtctagactcactgtgattatgctccatcgcttttcttcccagaatgcgaaaaagaaaatgtatggctgcacagaagccttcctggctgatgcaaagtggattttgcacaactgcatcatttataatgggggtgagtggcttagatgactcctaagaaagagtatgc

SEQ ID NO: 426835 - DNA, 577 bp, Homo sapiens
gcatttagggcccccaattatcagggtgttttcgagggggtcgccatctttcttggatacaagtcctcttcaatctggacctgaagttacaagtacaccttgaccaggctcagtgttgctttgttcactgaaattgagattgaatatctgcccataacctttgtctttggagggtccctaatgatgttgacttccacacactgagccatctggctgggattgtccattttaaatattgaaagtcacccagacgattgttcagtggactgtttaaacctgccaaacgtgttcacgtgggccattatcttcatgtcaccccatttggttgagcagatgatattgttgggatgaatgacaaaaaaagtatctccccctcccccatgttctaaaatgtgtgttttgctctgactttgcaaggacgaagctccgtgatgaggatggtgtgtgcctgatcttacgagggtgtgatggtttctttcagatcgaagcaaagctgagatggatttgaaggagctgagcgagtcggtccagcaacagtccacccctgttcctctcatctctcccaagcgccagattc

SEQ ID NO: 426836 - DNA, 5035 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426837 - DNA, 5110 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426838 - DNA, 5103 bp, Homo sapiens
tcgaatcgtaaccgttcgtacgagaatcgctgtcctctccttgctcgagatccattgtgctctaaagatcagtttgaaactcgcagggctgcttaaacaagagctacagctattgaacaaactgctaccattttagcttcaacacaggaatgaggcagtgttgccagacgccattttaagaatcctgcataaatagcttagctaccgatgactctgcctgttttagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426839 - DNA, 5232 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatggagtctcactttgtcacccaggctggagtgcagtggcactatctcagctcactgcacccctctgcttcctggttcaagcgattctcctgcctcagcctcctgagtagctgggactagagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426840 - DNA, 5106 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426841 - DNA, 5194 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426842 - DNA, 5141 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426843 - DNA, 4951 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426844 - DNA, 2181 bp, Homo sapiens
accatgatgaatgccctatttacagatgaagactcgggctaggttattgcccatgggcacacagccagggcttctcccagccagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426845 - DNA, 1550 bp, Homo sapiens
atctgcggcctggtctctctctcctatcctccccatggagcgccaaggtcctctgtcagagctctccctgtcctgccatccttctaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacaatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaatagcctagctggccttatttgtgaagcataattgcttttagcatatggaagtattttttcacattttctttgtataaaatttgtattaaacttaaatatctttt

SEQ ID NO: 426846 - DNA, 3594 bp, Homo sapiens
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaccaggtgtgacagagcaacctgc

SEQ ID NO: 426847 - DNA, 672 bp, Homo sapiens
agcggagaagccagctgagagcgcctgcgcggctgtcggttgatggggaggtcaggtctgggaaactaggccctggggttttccctgagcaggagcggtgcccgagggcctcaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggctccattaaagctcttttcttgca

SEQ ID NO: 426848 - DNA, 2029 bp, Homo sapiens
agcggagaagccagctgagagcgcctgcgcggctgtcggttgatggggaggtcaggtctgggaaactaggccctggggttttccctgagcaggagcggtgcccgagggcctcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagagagttttcatctaggaactttggtgtgaggaaccagggcaacttttctgtggttggtactgttcttgctgccacgcaggcggagaaggccgtggcaaactttgacaggacggagtgggtgcagatccgaagactagaagctgcaggggagagcttagaggaggaaatccgaagaaagcagattctcctgaggggaaagctgaagaagacagaggaggaactcagaaggatccagacgcaaaaggaacaggccaaggaaaatgaaaacggagagctacagaaaattatactccccaggagcagagttaaaggtaataaaagcaacaccatgtacaaacctatcttctccccagaatttgagtttgaggaagaatttagtagagacaggagagaggatgaaacttggggacggtctcaacaaaattcagttccattccagttctctgattatagaatccagaggctcaaaagggaaaggctggtagcaagcaataataaaattcgagacccagtctcagagccatcggtggagaaattctccccgccttcagaaacaccagtcggtgctttgcagggatctgccagaaattccagcctgtccatggcaccagactcctcaggttccagcggctccattgaagagccacagctgggtgagtgcagccactgtgggcgcaaattcctctcgttcaggctggagagacactccaacatctgcagcaggatgcggggttccaagaggaaagtgtttgactcctccagggcccgggctaagggcacagaactagagcagtacttgaactggaaggggccagcttcagccaaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggctccattaaagctcttttcttgca

SEQ ID NO: 426849 - DNA, 1579 bp, Homo sapiens
agcggagaagccagctgagagcgcctgcgcggctgtcggttgatggggaggtcaggtctgggaaactaggccctggggttttccctgagcaggagcggtgcccgagggcctcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagagagttttcatctaggaactttggtgtgaggaaccagggcaacttttctgtggttggtactgttcttgctgccacgcaggcggagaaggccgtggcaaactttgacaggacggagtgggtgcagatccgaagactagaagctgcaggggagagcttagaggaggaaatccgaagaaagcagattctcctgaggggaaagctgaagaagacagaggaggaactcagaaggatccagacgcaaaaggaacaggccaaggaaaatgaaaacggagagctacagaaaattatactccccaggagcagagttaaagtgctgtgcctttggaagctgagtggttgtaccttcctgtcattcctctagagtactcaagaacaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggctccattaaagctcttttcttgca

SEQ ID NO: 426850 - DNA, 1778 bp, Homo sapiens
agcggagaagccagctgagagcgcctgcgcggctgtcggttgatggggaggtcaggtctgggaaactaggccctggggttttccctgagcaggagcggtgcccgagggcctcaggtacgcagaagggcggggagacatgggatcagcacctccacctcctaagggaccgaagggcaggagagcgagaggacttgtccccagaggtggagtccgaagtgggggcgccccagttgacccttcgggacaaaacgtgacttcagccttaaggatctaaaaccggccgcggtcaggtcaggtggccctcaacgctcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagagagttttcatctaggaactttggtgtgaggaaccagggcaacttttctgtggttggtactgttcttgctgccacgcaggcggagaaggccgtggcaaactttgacaggacggagtgggtgcagatccgaagactagaagctgcaggggagagcttagaggaggaaatccgaagaaagcagattctcctgaggggaaagctgaagaagacagaggaggaactcagaaggatccagacgcaaaaggaacaggccaaggaaaatgaaaacggagagctacagaaaattatactccccaggagcagagttaaagtgctgtgcctttggaagctgagtggttgtaccttcctgtcattcctctagagtactcaagaacaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggctccattaaagctcttttcttgca

SEQ ID NO: 426851 - DNA, 589 bp, Homo sapiens
tcaggaaggagataggtgccaacttgaatgatcagtctcccttttacattacaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggc

SEQ ID NO: 426852 - DNA, 1514 bp, Homo sapiens
agcggagaagccagctgagagcgcctgcgcggctgtcggttgatggggaggtcaggtctgggaaactaggccctggggttttccctgagcaggagcggtgcccgagggcctcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagagagttttcatctaggaactttggtgtgaggaaccagggcaacttttctgtggttggtactgttcttgctgccacgcaggcggagaaggccgtggcaaactttgacaggacggagtgggtgcagatccgaagactagaagctgcaggggagagcttagaggaggaaatccgaagaaagcagattctcctgaggggaaagctgaagaagacagaggaggaactcagaaggatccagacgcaaaaggaacaggccaaggaaaatgaaaacggagagctacagaaaattatactccccaggagcagagttaaaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggctccattaaagctcttttcttgca

SEQ ID NO: 426853 - DNA, 2820 bp, Homo sapiens
  misc_feature (2815)..(2819): n is a, c, g, or t
agaaaaggggtttacaaatctctgtgggatgttggagcaggcttcctggaggaagcaggattcagtcaccaaaattttccagaagaagaagatcttggtgacgtacagtttccgtcagtctttccccctcgtggaaatgcacatgcagctcttccagaattcatattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcaggggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagcaatgtcctcctccccatgtcctccctgccttgggacccgtcctctcacccccagcagttgccatggggtttccttccagattcgaggatccttgccacttgaagcctggactcagggtgctccagcgctggggagtggtgagggccttccagagatcctcgtactctttctcccgtcttcttcttccccacttttccctggaggtctagctctgtggcctcagacctctgggcctgtgtgagctctctgtgagctctggctggcggagaagggcaggtgtccggagctgtcggggtgaaggcttccctggggctcctctggccgtgtggggctaggagagcgctctgtagagttgtggccaaacttcagctggcttggccctctctctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccctccctcacccatattgcatgcccccccgccattcccttacacctaccccacctacaactgaagacaatgcactttacagatatcacccacacacacctcgctggggcaggggcacccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggagaggagctggggttcaggcattgtcttttttcctccttgtatataagaatgtatatttgatgcctcataaaagaccttgtgctcaaaaaannnnnc

SEQ ID NO: 426854 - DNA, 3995 bp, Homo sapiens
cggcagcctcagctcctgctccccgtgccgccggccccagcgctgtctcccgggccccctagggcccccgggccctcaagcccggtgcgcgccctcgcgtcccgccggccccctcccccggctgggcccgggggagggtggcgccgtgagagagcggggacagggctctcctgcccgttcccctgcccctgggccgccaggatggaggcggggtcggggcccccgggcggcccgggatccgagagcccaaatcgggccgtggagtacctgctggagctgaacaacatcatcgagagccagcagcagctgctggaaacccagcggcggcgcatcgaggagctggagggccagctggaccagctcacccaggagaaccgcgacctgcgagaggagagccagctgcaccgcggggagctgcaccgggacccccacggcgcgcgggatagcccgggccgcgagagccagtaccagaacctgcgcgagacccagttccaccaccgcgagctgcgggagagccagttccaccaggcggcccgggacgtgggctacccgaaccgggaaggcgcctaccagaatcgggaggctgtgtatcgggacaaggagcgggacgcctcctacccgctccaggacactaccggttacacagcccgcgagcgtgacgtggcccagtgccacctgcaccacgagaacccagccctgggtcgcgagcgtggcgggcgggaggccgggccggcgcacccgggccgcgagaaggaagcgggctattcggcggcggtgggcgtggggccgcggccaccgcgggagcggggccagctgagccgtggcgcatccaggagctccagtcccggcgccggcggaggccacagcaccagtaccagcaccagcccggccacgaccctccagagaaaatctgatggtgagaattccagaacagtcagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggactgtgtggtggatgagatggacttctcctccatggatctggatgatgcgctccggaagttccagtcccatatccgggttcagggtgaggcccagaaagtggagcgactcatcgaagccttcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtcctgtctctccctcaccgtcgactggtttgctgctgccagctctacgaggtgccagatccaaaccgcccccagaggctagggttgcatcagcgggaggtcttcctcttcaatgatctccttgtggtcaccaaaattttccagaagaagaagatcttggtgacgtacagtttccgtcagtctttccccctcgtggaaatgcacatgcagctcttccagaattcatattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtgtgagtagcccagccatgtctcctccctgctctcctgaaacagtaccctgcagaaaccaagaatcctatcctcagagaatctcagagttgagggttagcttgtccaaccttcccatcctcatttcaagaattcttcagcctctgcttgaataccttcagtgacaaggggctcattacctcccaaccccattattatcctgaactctaattatgagccaactattccttctagtgaaaggtatcagggagaagaatcagagtattggaggtaggactatagttttagatcccaggtatactactcattatctgggtgaactgcagcaaattgcctaacctgccaagccccagtttcttcctatacgaaattggggtaatgaagtctccttcacagagtcatggagatgaaatgagacaaggtagccgaaatgtcccaacacatcttaggcattcaaaaaatccgtatttcctgtcccaccctctctcctcctctgcccacatatcatttccctgagct

SEQ ID NO: 426855 - DNA, 6022 bp, Homo sapiens
  misc_feature (6017)..(6021): n is a, c, g, or t
cggcagcctcagctcctgctccccgtgccgccggccccagcgctgtctcccgggccccctagggcccccgggccctcaagcccggtgcgcgccctcgcgtcccgccggccccctcccccggctgggcccgggggagggtggcgccgtgagagagcggggacagggctctcctgcccgttcccctgcccctgggccgccaggatggaggcggggtcggggcccccgggcggcccgggatccgagagcccaaatcgggccgtggagtacctgctggagctgaacaacatcatcgagagccagcagcagctgctggaaacccagcggcggcgcatcgaggagctggagggccagctggaccagctcacccaggagaaccgcgacctgcgagaggagagccagctgcaccgcggggagctgcaccgggacccccacggcgcgcgggatagcccgggccgcgagagccagtaccagaacctgcgcgagacccagttccaccaccgcgagctgcgggagagccagttccaccaggcggcccgggacgtgggctacccgaaccgggaaggcgcctaccagaatcgggaggctgtgtatcgggacaaggagcgggacgcctcctacccgctccaggacactaccggttacacagcccgcgagcgtgacgtggcccagtgccacctgcaccacgagaacccagccctgggtcgcgagcgtggcgggcgggaggccgggccggcgcacccgggccgcgagaaggaagcgggctattcggcggcggtgggcgtggggccgcggccaccgcgggagcggggccagctgagccgtggcgcatccaggagctccagtcccggcgccggcggaggccacagcaccagtaccagcaccagcccggccacgaccctccagagaaaatctgatggtgagaattccagaacagtcagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggactgtgtggtggatgagatggacttctcctccatggatctggatgatgcgctccggaagttccagtcccatatccgggttcagggtgaggcccagaaagtggagcgactcatcgaagccttcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtcctgtctctccctcaccgtcgactggtttgctgctgccagctctacgaggtgccagatccaaaccgcccccagaggctagggttgcatcagcgggaggtcttcctcttcaatgatctccttgtggtcaccaaaattttccagaagaagaagatcttggtgacgtacagtttccgtcagtctttccccctcgtggaaatgcacatgcagctcttccagaattcatattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcagggaagcgggggcggcgtaacagcgtgggatcgctggacagcaccatcgaagggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagcaatgtcctcctccccatgtcctccctgccttgggacccgtcctctcacccccagcagttgccatggggtttccttccagattcgaggatccttgccacttgaagcctggactcagggtgctccagcgctggggagtggtgagggccttccagagatcctcgtactctttctcccgtcttcttcttccccacttttccctggaggtctagctctgtggcctcagacctctgggcctgtgtgagctctctgtgagctctggctggcggagaagggcaggtgtccggagctgtcggggtgaaggcttccctggggctcctctggccgtgtggggctaggagagcgctctgtagagttgtggccaaacttcagctggcttggccctctctctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccctccctcacccatattgcatgcccccccgccattcccttacacctaccccacctacaactgaagacaatgcactttacagatatcacccacacacacctcgctggggcaggggcacccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggagaggagctggggttcaggcattgtcttttttcctccttgtatataagaatgtatatttgatgcctcataaaagaccttgtgctcaaaaaannnnnc

SEQ ID NO: 426856 - DNA, 2713 bp, Homo sapiens
  misc_feature (2708)..(2712): n is a, c, g, or t
ttgggggagacaagggctggtcgtccaaggggcaaaacacgaagcctggggacagagggagggaggagggaggaggaaggagaatggcccatggagggctagggtcagtcagatgggctctcactcctgttcctgacctttgctccctgtctccccgactgccacccagcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcagggaagcgggggcggcgtaacagcgtgggatcgctggacagcaccatcgaagggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagcaatgtcctcctccccatgtcctccctgccttgggacccgtcctctcacccccagcagttgccatggggtttccttccagattcgaggatccttgccacttgaagcctggactcagggtgctccagcgctggggagtggtgagggccttccagagatcctcgtactctttctcccgtcttcttcttccccacttttccctggaggtctagctctgtggcctcagacctctgggcctgtgtgagctctctgtgagctctggctggcggagaagggcaggtgtccggagctgtcggggtgaaggcttccctggggctcctctggccgtgtggggctaggagagcgctctgtagagttgtggccaaacttcagctggcttggccctctctctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccctccctcacccatattgcatgcccccccgccattcccttacacctaccccacctacaactgaagacaatgcactttacagatatcacccacacacacctcgctggggcaggggcacccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggagaggagctggggttcaggcattgtcttttttcctccttgtatataagaatgtatatttgatgcctcataaaagaccttgtgctcaaaaaannnnnc

SEQ ID NO: 426857 - DNA, 3603 bp, Homo sapiens
cggcagcctcagctcctgctccccgtgccgccggccccagcgctgtctcccgggccccctagggcccccgggccctcaagcccggtgcgcgccctcgcgtcccgccggccccctcccccggctgggcccgggggagggtggcgccgtgagagagcggggacagggctctcctgcccgttcccctgcccctgggccgccaggatggaggcggggtcggggcccccgggcggcccgggatccgagagcccaaatcgggccgtggagtacctgctggagctgaacaacatcatcgagagccagcagcagctgctggaaacccagcggcggcgcatcgaggagctggagggccagctggaccagctcacccaggagaaccgcgacctgcgagaggagagccagctgcaccgcggggagctgcaccgggacccccacggcgcgcgggatagcccgggccgcgagagccagtaccagaacctgcgcgagacccagttccaccaccgcgagctgcgggagagccagttccaccaggcggcccgggacgtgggctacccgaaccgggaaggcgcctaccagaatcgggaggctgtgtatcgggacaaggagcgggacgcctcctacccgctccaggacactaccggttacacagcccgcgagcgtgacgtggcccagtgccacctgcaccacgagaacccagccctgggtcgcgagcgtggcgggcgggaggccgggccggcgcacccgggccgcgagaaggaagcgggctattcggcggcggtgggcgtggggccgcggccaccgcgggagcggggccagctgagccgtggcgcatccaggagctccagtcccggcgccggcggaggccacagcaccagtaccagcaccagcccggccacgaccctccagagaaaatctgatggtgagaattccagaacagtcagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggactgtgtggtggatgagatggacttctcctccatggatctggatgatgcgctccggaagttccagtcccatatccgggttcagggtgaggcccagaaagtggagcgactcatcgaagccttcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtcctgtctctccctcaccgtcgactggtttgctgctgccagctctacgaggtgccagatccaaaccgcccccagaggctagggttgcatcagcgggaggtcttcctcttcaatgatctccttgtggtcaccaaaattttccagaagaagaagatcttggtgacgtacagtttccgtcagtctttccccctcgtggaaatgcacatagttcagcgtctgacgtcagacgctgaactatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgcagcaggtgctccacatagttcagcgctgacgg

SEQ ID NO: 426858 - DNA, 3381 bp, Homo sapiens
ggggaaaccgttatagggcatgaaaggggaaaccgttatagggcatggaaggggaattaggacaaggtgtgagtggaaagagaaacatcccaccgcacacgcttaaaaaagccgtttaatttaaaaataggtaatacagccatacagagaagacattaaaagatctacacagaaaattttcgctcccaatccattccctactcacagtcctacatacgttacttttattttccttttttttggaaatgcactggccccctactctctcacgaaggctgaactctctctacattcttctgcacctgttttttgtgcatactctttcgttgtcaaatatttccctccaactgttgttgtgtatgaaataaatacacacatataagctaaccagccccacttgcccgcaccacctacacgcccgtccccgccctccctcaggcccacgtgctccgagggccgccttcgcaggttgtttctggcgatgcctgtctgaaggcctcagactgaggccccgcccactctccctctcctctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgt

SEQ ID NO: 426859 - DNA, 1002 bp, Homo sapiens
ggggaaaccgttatagggcatgaaaggggaaaccgttatagggcatggaaggggaattaggacaaggtgtgagtggaaagagaaacatcccaccgcacacgcttaaaaaagccgtttaatttaaaaataggtaatacagccatacagagaagacattaaaagatctacacagaaaattttcgctcccaatccattccctactcacagtcctacatacgttacttttattttccttttttttggaaatgcactggccccctactctctcacgaaggctgaactctctctacattcttctgcacctgttttttgtgcatactctttcgttgtcaaatatttccctccaactgttgttgtgtatgaaataaatacacacatataagctaaccagccccacttgcccgcaccacctacacgcccgtccccgccctccctcaggcccacgtgctccgagggccgccttcgcaggttgtttctggcgatgcctgtctgaaggcctcagactgaggccccgcccactctccctctcctctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggcgagccccctcccttccccattccctttgcctttccatgcctagttgggccacttcgcccggccctcctctgtcgctcagtctcgggcggtggggacgcctccgagggtgggttgcttcccctctagctttaggttaggcactccccgcccccgcccaaaatttt

SEQ ID NO: 426860 - DNA, 3949 bp, Homo sapiens
ggggaaaccgttatagggcatgaaaggggaaaccgttatagggcatggaaggggaattaggacaaggtgtgagtggaaagagaaacatcccaccgcacacgcttaaaaaagccgtttaatttaaaaataggtaatacagccatacagagaagacattaaaagatctacacagaaaattttcgctcccaatccattccctactcacagtcctacatacgttacttttattttccttttttttggaaatgcactggccccctactctctcacgaaggctgaactctctctacattcttctgcacctgttttttgtgcatactctttcgttgtcaaatatttccctccaactgttgttgtgtatgaaataaatacacacatataagctaaccagccccacttgcccgcaccacctacacgcccgtccccgccctccctcaggcccacgtgctccgagggccgccttcgcaggttgtttctggcgatgcctgtctgaaggcctcagactgaggccccgcccactctccctctcctctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgtaagtgagtgtgctgctgtaagaaatctcccatgtgcataacaaattctgaatattttttgaggctaaagaagaccggggtgacaagcagatactgctgtgtaatggttacactaaccaaaagacaccagccactcagagttctatactgtaaagcgcagataacatttgtgtgttataccttgattggggaattaaaagtcatttaactgaagatgttgagaaacctgggctctggttttagtataccggaattacttttttccaattttagaaaatcaagcaggttagagaaaatagagatgaattaggggacactgtcttatggattcatttataagaagagaaccagccatatacacttggggagatttgccacatcttaaacttgaataatagtatgagtaatgcttaagggagtttaatagagaaggaaagctttggcagtgttttgagaacttaagtggctaaagagatgagacaaacatgcaggtcgctactggcatagtttcataattgtgtactcggaaattaaagtttgcttgtttcttggtctggaaaaaaaaaaaa

SEQ ID NO: 426861 - DNA, 3170 bp, Homo sapiens
tgacttttatttggccctttgtgtgtgtgtgtgtgtatgtgtgtatgtgtgtatatgcacctgtgtgtatttgaatccagcactgtcaatgcgatggggacccatgaccaacagccccagagaaaccacaacacgatcagaatacatgaagaagagaacgccccgccaagaatcatagcacacatctcaagttgtgacatggaaccttcattgtaaggtattgccagcacagctaaaggagctgaagtatattttcagatacaagaatgatataataatgcatttacacgtgccagaggcaagtgatttttcttaatgatacggagttggtcatcctgattgtgaatacttggtaaaggcttttttctgccaaatatgggaggaagaagcaatccaattttaggcatcctctgaggagtgaacaggaatagcagctggtgtgcatctccttaaggatgacgttatttatgacaaccaaaccaattaccagtgtgtctcctaatatattcccttttagcaagttgtttatttttcagtatagctaattagtagggaaactggggatgatattttgaaagccaggttgaaaagcacagatgtgtacgttagttgtgaggtttttttgttgattaatttccagatagattacttagattattaagcaagaactgtatttgaaatttggttaagtttttcatttggttatcttttgtgactagttccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgt

SEQ ID NO: 426862 - DNA, 3325 bp, Homo sapiens
ggggaaaccgttatagggcatgaaaggggaaaccgttatagggcatggaaggggaattaggacaaggtgtgagtggaaagagaaacatcccaccgcacacgcttaaaaaagccgtttaatttaaaaataggtaatacagccatacagagaagacattaaaagatctacacagaaaattttcgctcccaatccattccctactcacagtcctacatacgttacttttattttccttttttttggaaatgcactggccccctactctctcacgaaggctgaactctctctacattcttctgcacctgttttttgtgcatactctttcgttgtcaaatatttccctccaactgttgttgtgtatgaaataaatacacacatataagctaaccagccccacttgcccgcaccacctacacgcccgtccccgccctccctcaggcccacgtgctccgagggccgccttcgcaggttgtttctggcgatgcctgtctgaaggcctcagactgaggccccgcccactctccctctcctctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacaatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgt

SEQ ID NO: 426863 - DNA, 3190 bp, Homo sapiens
ggggaaaccgttatagggcatgaaaggggaaaccgttatagggcatggaaggggaattaggacaaggtgtgagtggaaagagaaacatcccaccgcacacgcttaaaaaagccgtttaatttaaaaataggtaatacagccatacagagaagacattaaaagatctacacagaaaattttcgctcccaatccattccctactcacagtcctacatacgttacttttattttccttttttttggaaatgcactggccccctactctctcacgaaggctgaactctctctacattcttctgcacctgttttttgtgcatactctttcgttgtcaaatatttccctccaactgttgttgtgtatgaaataaatacacacatataagctaaccagccccacttgcccgcaccacctacacgcccgtccccgccctccctcaggcccacgtgctccgagggccgccttcgcaggttgtttctggcgatgcctgtctgaaggcctcagactgaggccccgcccactctccctctcctctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgt

SEQ ID NO: 426864 - DNA, 3265 bp, Homo sapiens
ggggaaaccgttatagggcatgaaaggggaaaccgttatagggcatggaaggggaattaggacaaggtgtgagtggaaagagaaacatcccaccgcacacgcttaaaaaagccgtttaatttaaaaataggtaatacagccatacagagaagacattaaaagatctacacagaaaattttcgctcccaatccattccctactcacagtcctacatacgttacttttattttccttttttttggaaatgcactggccccctactctctcacgaaggctgaactctctctacattcttctgcacctgttttttgtgcatactctttcgttgtcaaatatttccctccaactgttgttgtgtatgaaataaatacacacatataagctaaccagccccacttgcccgcaccacctacacgcccgtccccgccctccctcaggcccacgtgctccgagggccgccttcgcaggttgtttctggcgatgcctgtctgaaggcctcagactgaggccccgcccactctccctctcctctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagttgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgt

SEQ ID NO: 426865 - DNA, 3301 bp, Homo sapiens
ggggaaaccgttatagggcatgaaaggggaaaccgttatagggcatggaaggggaattaggacaaggtgtgagtggaaagagaaacatcccaccgcacacgcttaaaaaagccgtttaatttaaaaataggtaatacagccatacagagaagacattaaaagatctacacagaaaattttcgctcccaatccattccctactcacagtcctacatacgttacttttattttccttttttttggaaatgcactggccccctactctctcacgaaggctgaactctctctacattcttctgcacctgttttttgtgcatactctttcgttgtcaaatatttccctccaactgttgttgtgtatgaaataaatacacacatataagctaaccagccccacttgcccgcaccacctacacgcccgtccccgccctccctcaggcccacgtgctccgagggccgccttcgcaggttgtttctggcgatgcctgtctgaaggcctcagactgaggccccgcccactctccctctcctctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcatcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgt

SEQ ID NO: 426866 - DNA, 1325 bp, Homo sapiens
gcatcccccggtctgcaggaattcggttcgagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgt

SEQ ID NO: 426867 - DNA, 1038 bp, Homo sapiens
taacatgatcaatcagctcggtaccctcgatagggccaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgt

SEQ ID NO: 426868 - DNA, 853 bp, Homo sapiens
catgctgctcttgaggtaaccgacgccactgaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgt

SEQ ID NO: 426869 - DNA, 436 bp, Homo sapiens
cagtgtgtctcctaatatattcccttttagcaagttgtttatttttcagtatagctaattagtagggaaactggggatgatattttgaaagccaggttgaaaagcacagatgtgtacgttagttgtgaggtttttttgttgattaatttccagatagattacttagattattaagcaagaactgtatttgaaatttggttaagtttttcatttggttatcttttgtgactagttccaaagaggtgtttgaaagctcgagaacattttggtacagtaaaaacacatctaacatctttgaagaccaaatttcctgctgaacagtattacaggtttgtaagaaaaatagcattattttataatgttaagtaaaaaaaaggagaaaaattatgtgtaccaaatgattgcttacaactaggcaaacatcctgtgtagaagt

SEQ ID NO: 426870 - DNA, 1913 bp, Homo sapiens
ggggaaaccgttatagggcatgaaaggggaaaccgttatagggcatggaaggggaattaggacaaggtgtgagtggaaagagaaacatcccaccgcacacgcttaaaaaagccgtttaatttaaaaataggtaatacagccatacagagaagacattaaaagatctacacagaaaattttcgctcccaatccattccctactcacagtcctacatacgttacttttattttccttttttttggaaatgcactggccccctactctctcacgaaggctgaactctctctacattcttctgcacctgttttttgtgcatactctttcgttgtcaaatatttccctccaactgttgttgtgtatgaaataaatacacacatataagctaaccagccccacttgcccgcaccacctacacgcccgtccccgccctccctcaggcccacgtgctccgagggccgccttcgcaggttgtttctggcgatgcctgtctgaaggcctcagactgaggccccgcccactctccctctcctctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaagg

SEQ ID NO: 426871 - DNA, 2450 bp, Homo sapiens
ttacaacagctcctacaacagctccagttacaacagctacgtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgt

SEQ ID NO: 426872 - DNA, 2288 bp, Homo sapiens
ctcgctactcaatacagtttaccaagaagcattcgagaaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgt

SEQ ID NO: 426873 - DNA, 869 bp, Homo sapiens
caagaatttccatagaattgacgcttccttaaaaaaatgaagttaatccggatgggtaaacccttccccccacagggtatccaggaataccggaccccgtaaagagatcccccttggaaaattaaggccaataatagggtttcaagatgtttcacccctattttgaagaggaagaagatgaagattaaagaagaactgccagatatggaaggatatgaaagaagtggattgtgtgaaccagataggcctcccctagatccaaggaaatagttagaagcttgtaaagccaaaactgatgctgccggtgaagatgctattttcaaaccagaccttatgacctttacatcacttatgataaatattacaagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 426874 - DNA, 1626 bp, Homo sapiens
caagaatttccatagaattgacgcttccttaaaaaaatgaagttaatccggatgggtaaacccttccccccacagggtatccaggaataccggaccccgtaaagagatcccccttggaaaattaaggccaataatagggtttcaagatgtttcacccctattttgaagaggaagaagatgaagattaaagaagaactgccagatatggaaggatatgaaagaagtggattgtgtgaaccagataggcctcccctagatccaaggaaatagttagaagcttgtaaagccaaaactgatgctgccggtgaagatgctattttcaaaccagaccttatgacctttacatcacttatgataaatattacaagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagagaaaaaaaaaaaaaaaaaacaacacaaaaaacacaaacacacacacaaaacacaaaaaacaaaaaaaacaaaaacaaacacaccacaccacaacaacaaacaaaacacacacaaaaacaacaaaaaaaacaaaaaaaaaaaggaggcgggcgcccatccaaaaaaaactcccgcggagaggccaaacagaacacgacaaccaccacaatagccaaaaagaggcgcacaaaagagacgacaacatataaaacaaggagagagacaacaataaagagaaagggagagaagcagacaacacaagaaaagaaacaacaggagaaaacacaaaaaaggcgagaacacacaagagacacaccacgacaaagaagaacacgacgagcgggagacagaacacgccaggccgcacggcgggccacacacccacagaacgcgcggagagaacgaagcgcgcgacaagagagcaacagaacaatatgcgggagagagacaacacacggacgaccacacgaaacgagacgccggagcgggaggcacgaagacggccggcagcgagcgaacggcccccgaaagcgggcgagagggacgaggaggcgcagcaggcagacgcgagggcaaggacgccccgcagccccgcacgccggcggaggcgagcaagacaggaggcacgacgcgggagcgagcgcagcgagcgacgcagcagcggcgcgcgcgccacgggcggacagcgagccacgggcgcggggcgaaataaacgcacgc

SEQ ID NO: 426875 - DNA, 397 bp, Homo sapiens
agccagaccccaaccaaaacaaaaaaaatataatataaaaatcttcagcgtgactgggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 426876 - DNA, 881 bp, Homo sapiens
ggatgctaggtagcaacttggaagactgtctatatataattcataatagtaattggtttcccccaatgaaaagtaagctcctaatgtttttaagtgcaatgaacataaaaaaatttcagaatttaattaaagacagtccagtagagctcagtctttggcaaatacatacactaacctagaatcagtctactatacaggatttttatttaatttttttctcttttgctatagtacttcattatagtctattctgcctcattttctgacataactctagcaaacttaaaggagtctagtaaatgagtacattttgtactcatttaaacatgtatagctttgtcctttttatgtcaaagtaattgtgcttatatgaacacctactcattaagaagtttcaaattcaataatcgaatgagtggtcaggtagtcttaaagagcctcatgttaaatagacacaaatttgcatagttgaattctttaatagacttaatttaagattttgtggggtttttttgagaaattaatggcttaataaaatggataattacaacatgggcttaaaacatagaactatttacaaatcttattttccttagctaaaaacctttaggtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 426877 - DNA, 833 bp, Homo sapiens
caagaatttccatagaattgacgcttccttaaaaaaatgaagttaatccggatgggtaaacccttccccccacagggtatccaggaataccggaccccgtaaagagatcccccttggaaaattaaggccaataatagggtttcaagatgtttcacccctattttgaagaggaagaagatgaagattaaagaagaactgccagatatggaaggatatgaaagaagtggattgtgtgaaccagataggcctcccctagatccaaggaaatagttagaagcttgtaaagccaaaactgatgctgccggtgaagatgctattttcaaaccagaccttatgacctttacatcacttatgataaatattacaagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactacc

SEQ ID NO: 426878 - DNA, 399 bp, Homo sapiens
cgagcgtggccgaaagacaaacaaataataattataaatttattccttagcgtgacgcagcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 426879 - DNA, 392 bp, Homo sapiens
tttatatattttatcgcattatattggtctcccaaattctttcccctcttcagcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 426880 - DNA, 1582 bp, Homo sapiens
gaaaagaggctgaggcaacctgaaggaggagctctcattaccttctgcccatcacttaataaatagccagccaattcatcaacattctggtacactgttggagagatgagacagtcacaccagctgcccctagtggggctcttactgttttcttttattccaagccaactatgcgagatttgtgaggtaagtgaagaaaactacatccgcctaaaacctctgttgaatacaatgatccagtcaaactataacaggggaaccagcgctgtcaatgttgtgttgtccctcaaacttgttggaatccagatccaaaccctgatgcaaaagatgatccaacaaatcaaatacaatgtgaaaagcagattgtcagatgtaagctcgggagagcttgccttgattatactggctttgggagtatgtcgtaacgctgaggaaaacttaatatatgattaccacctgatcgacaagctagaaaataaattccaagcagaaattgaaaatatggaagcacacaatggcactcccctgactaactactaccagctcagcctggacgttttggccttgtgtctgttcaatgggaactactcaaccgccgaagttgtcaaccacttcactcctgaaaataaaaactattattttggtagccagttctcagtagatactggtgcaatggctgtcctggctctgacctgtgtgaagaagagtctaataaatgggcagatcaaagcagatgaaggcagtttaaagaacatcagtatttatacaaagtcactggtagaaaagattctgtctgagaaaaaagaaaatggtctcattggaaacacatttagcacaggagaagccatgcaggccctctttgtatcatcagactattataatgaaaatgactggaattgccaacaaactctgaatacagtgctcacggaaatttctcaaggagcattcagcaatccaaacgctgcagcccaggtcttacctgccctgatgggaaagaccttcttggatattaacaaagactcttcttgcgtctctgcttcaggtaacttcaacatctccgctgatgagcctataactgtgacacctcctgactcacaatcatatatctccgtcaattactctgtgagaatcaatgaaacatatttcaccaatgtcactgtgctaaatggttctgtcttcctcagtgtgatggagaaagcccagaaaatgaatgatactatatttggtttcacaatggaggagcgctcatgggggccctatatcacctgtattcagggcctatgtgccaacaataatgacagaacctactgggaacttctgagtggaggcgaaccactgagccaaggagctggtagttacgttgtccgcaatggagaaaacttggaggttcgctggagcaaatactaataagcccaaactttcctcagctgcataaaatccatttgcagtggagttccatgtttattgtccttatgccttcttcttcatttatcccagtacgagcaggagagttaataacctccccttctctctctacatgttcaataaaagttgttgaaagattaacaactatacaaaaaga

SEQ ID NO: 426881 - DNA, 1201 bp, Homo sapiens
gaaaagaggctgaggcaacctgaaggaggagctctcattaccttctgcccatcacttaataaatagccagccaattcatcaacattctggtacactgttggagagatgagacagtcacaccagctgcccctagtggggctcttactgttttcttttattccaagccaactatgcgagatttgtgaggtaagtgaagaaaactacatccgcctaaaacctctgttgaatacaatgatccagtcaaactataacaggggaaccagcgctgtcaatgttgtgttgtccctcaaacttgttggaatccagatccaaaccctgatgcaaaagatgatccaacaaatcaaatacaatgtgaaaagcagattgtcagatgtaagctcgggagagcttgccttgattatactggctttgggagtatgtcgtaacgctgaggaaaacttaatatatgattaccacctgatcgacaagctagaaaataaattccaagcagaaattgaaaatatggaagcacacaatggcactcccctgactaactactaccagctcagcctggacgttttggccttgtgtctgttcaatgggaactactcaaccgccgaagttgtcaaccacttcactcctgaaaataaaaactattattttggtagccagttctcagtaggtaacttcaacatctccgctgatgagcctataactgtgacacctcctgactcacaatcatatatctccgtcaattactctgtgagaatcaatgaaacatatttcaccaatgtcactgtgctaaatggttctgtcttcctcagtgtgatggagaaagcccagaaaatgaatgatactatatttggtttcacaatggaggagcgctcatgggggccctatatcacctgtattcagggcctatgtgccaacaataatgacagaacctactgggaacttctgagtggaggcgaaccactgagccaaggagctggtagttacgttgtccgcaatggagaaaacttggaggttcgctggagcaaatactaataagcccaaactttcctcagctgcataaaatccatttgcagtggagttccatgtttattgtccttatgccttcttcttcatttatcccagtacgagcaggagagttaataacctccccttctctctctacatgttcaataaaagttgttgaaagattaacaactatacaaaaaga

SEQ ID NO: 426882 - DNA, 387 bp, Homo sapiens
gtcatcaagtgattctcaggtacattaaagtttgagaaatgcctattgttggtttcctttgacaattctaagttccagtaacctacttgctgtcacccacagtttcacaatggaggagcgctcatgggggccctatatcacctgtattcagggcctatgtgccaacaataatgacagaacctactgggaacttctgagtggaggcgaaccactgagccaaggtaagggagagacatgccaaaaagacccatgctaaaaatgcccaaatggagaggggtgtgagcctctgtggggattgggccaaggggttagtagagatgacatccattatttggtgatttagtggccaaatcatttgacccagttctctttcttcttccttttcag

SEQ ID NO: 426883 - DNA, 1402 bp, Homo sapiens
gaaaagaggctgaggcaacctgaaggaggagctctcattaccttctgcccatcacttaataaatagccagccaattcatcaacattctggtacactgttggagagatgagacagtcacaccagctgcccctagtggggctcttactgttttcttttattccaagccaactatgcgagatttgtgtgtcagatgtaagctcgggagagcttgccttgattatactggctttgggagtatgtcgtaacgctgaggaaaacttaatatatgattaccacctgatcgacaagctagaaaataaattccaagcagaaattgaaaatatggaagcacacaatggcactcccctgactaactactaccagctcagcctggacgttttggccttgtgtctgttcaatgggaactactcaaccgccgaagttgtcaaccacttcactcctgaaaataaaaactattattttggtagccagttctcagtagatactggtgcaatggctgtcctggctctgacctgtgtgaagaagagtctaataaatgggcagatcaaagcagatgaaggcagtttaaagaacatcagtatttatacaaagtcactggtagaaaagattctgtctgagaaaaaagaaaatggtctcattggaaacacatttagcacaggagaagccatgcaggccctctttgtatcatcagactattataatgaaaatgactggaattgccaacaaactctgaatacagtgctcacggaaatttctcaaggagcattcagcaatccaaacgctgcagcccaggtcttacctgccctgatgggaaagaccttcttggatattaacaaagactcttcttgcgtctctgcttcaggtaacttcaacatctccgctgatgagcctataactgtgacacctcctgactcacaatcatatatctccgtcaattactctgtgagaatcaatgaaacatatttcaccaatgtcactgtgctaaatggttctgtcttcctcagtgtgatggagaaagcccagaaaatgaatgatactatatttggtttcacaatggaggagcgctcatgggggccctatatcacctgtattcagggcctatgtgccaacaataatgacagaacctactgggaacttctgagtggaggcgaaccactgagccaaggagctggtagttacgttgtccgcaatggagaaaacttggaggttcgctggagcaaatactaataagcccaaactttcctcagctgcataaaatccatttgcagtggagttccatgtttattgtccttatgccttcttcttcatttatcccagtacgagcaggagagttaataacctccccttctctctctacatgttcaataaaagttgttgaaagattaacaactatacaaaaaga

SEQ ID NO: 426884 - DNA, 5163 bp, Homo sapiens
aagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaagtcaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgatatctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaaatcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagaccaaggtgtatacttcagtctgcaggtgtgtggacactcccttctccctgcatgaccccaaatacagagcggatcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttatatattaaaattcatttgccaaactcaaaatgatgatg

SEQ ID NO: 426885 - DNA, 5128 bp, Homo sapiens
aagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaagtcaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgatatctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaaatcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagaccaaggtgtatacttcagtctgcaggtgtgtggacactcccttctccctgcatgaccccaaatacagagcggatcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgtggctttggtctgcgtttcttacttgcagcttggataacatgtttttaaaatgggaaatactggtttttatgtttcctaagaatcgatgtgggaaatgtgtatcagtttccttgtctcttttcctgtgtagaaatggaac

SEQ ID NO: 426886 - DNA, 1644 bp, Homo sapiens
aagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggtaagttatggagaaggctttgtccccttaatgcttatcagtattctcctgaaaatgggagcataccccaagttgtcagcctgtgaccagcttggagcaaggagaacagtagaagttagaactcaagggcaggtccagaacaggggccaggtgaaggtggcctgtgtttggttttgaatgtgcgtcagtgtttgcttccattggaatgtgggcataggaaaccttcagaggggctgctggagggtggtggacctccttgcctgcctggggcccctctgctcccctcccccaagtgctgatggtgttagccacaaggtcacgcacatccccagtctgaggcaaaccaaggactcttgcatcttttaggcatgagaggacaaaatctcaaaccccaaactgcttgtcagctgtaggctggatatagtctagtttaagtaagaaaaagatgtaaaggttcggtacatcaggcaaggagttagacaaaaaaagacacgtgagctgatttagggcggtgattccctaatctccatgcacattagaattccctggggaagctgttcaaaaatgctgatgcccaggccgcatacccaggggctctgatgcactaagatttgtccacacaaatctggcccaacaggatgcagataatctggcccaacaggaattcagtaataaggatttttccccaaaaaatatgcactgtattcttagaaactttattcccgtcatctttctactttaaaaggcatttaccccatgaaatgtatctcttttggtattttcctgactgcaaatgcaaaaacaaggaccaacgaatcccaggactgcaatagaccactgacctttagtcagtgaagaactgattccccaaaccacacttaacactcccctgctttctccatgcaaatgcagaattt

SEQ ID NO: 426887 - DNA, 411 bp, Homo sapiens
ttttgccagtcctcatttgtaaggtgcatgttatgtgattaaaattaacctcccatcttgcagtgattacagcaacataaaggcagcatatgaggccatgaagaatgtggcctgtctgatcaacgagcgcaagcgcaagctggagagcatcgacaagatagctcgctggcaggtgtctatcgtgggctgggaggtaagtggaaagcaccccacatgatcccatgccactcgcccttcccgcacctttgatctggtgcagatgcactttaatatcctgtggtcaatatcttatattcttggctttaatggtacatataccattaatggtaaatgtatttcgaggcatactgttgaatttaacagtcgactactttataccccactcccataagaaataaaatctgaagagta

SEQ ID NO: 426888 - DNA, 5217 bp, Homo sapiens
aagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaagtcaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaaatcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagaccaaggtgtatacttcagtctgcaggtgtgtggacactcccttctccctgcatgaccccaaatacagagcggatcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttatatattaaaattcatttgccaaactcaaaatgatgatg

SEQ ID NO: 426889 - DNA, 3674 bp, Homo sapiens
aagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaagtcaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgatatctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaaatcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagaccaaggtgtatacttcagtctgcaggtgtgtggacactcccttctccctgcatgaccccaaatacagagcggatcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtacttcgtatctccaccccgcaaacttcactccctctcccacgtctcgtcttccacttcggccggaaatggaaaccg

SEQ ID NO: 426890 - DNA, 549 bp, Homo sapiens
gctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggtgagcagcccttggctctgcaggcacctgtgcctctgcttgctgtaatagcttcattctccactcccatgggcctgctctgcccagccttctccctcagagctgaatcccaccatggggaaaggacaagggatctgcaaaccctaaatacttctgaatgcacttacaagacagaccatgtcagatgtagttactaccggcaacatttattcagtatttaccttgtgccagacattctgtggcccatttatagagattgtctcattgaatccctatgaagtggttgctgttattatacccaatttacagatgagaaaattgaggcttatggaactggcccact

SEQ ID NO: 426891 - DNA, 866 bp, Homo sapiens
gcatcctcccagcatgttccatgtagttgttataactgggtggggggtggggggcggcgggagggggaaaccataccctgaagtccagtcattgacaaatcttcccgctgatggtgatgtcaatttccaaagcagcttctccagccaaaatcgcaggtctcaaaactccccatgtgtctcccagtaacctggacggaagggagtcctctctgctcagaaccacacccctcgtaccaatgctgccatctcgttcaggccccacgtcgctccttgctctaggattaacaccagatagcatgaatagcagtctcaatacaactggatgaggccctagacttcccgaggaaatggagtcacaaacaccaagccacgtcgactcttgccgaccactggcccagcatccactgaaagtcgggaacacaaaaatgtcacttttcctctttaagctgcctaacggtcactacaagcttacattgagatgctctaagtctgtataccttgtgataattagtaccacactgtagaattaggaaatcaataaccaagtgtttttattgcatatactgtagtcctgtctaaatgccttctagcaggaatatagtaatgtagtgcttattctgtgaatattaccatgtattttttacactgtacagtatagaaaacacaggttaactccgaagtggcaggcatgctccactacaacagacagacaacttttgctgtaagcaatacctagtggtatgagaattctatttcaagtcctaaaatatttcaacttacagcttgtttggaaaaaaatttccatttttgtaaaaatatatgtttcctgattacctcttgctaataaatctattctatctcagggt

SEQ ID NO: 426892 - DNA, 1837 bp, Homo sapiens
gcatcctcccagcatgttccatgtagttgttataactgggtggggggtggggggcggcgggagggggaaaccataccctgaagtccagtcattgacaaatcttcccgctgatggtgatgtcaatttccaaagcagcttctccagccaaaatcgcaggtctcaaaactccccatgtgtctcccagtaacctggacggaagggagtcctctctgctcagaaccacacccctcgtaccaatgctgccatctcgttcaggccccacgtcgctccttgctctaggattaacaccagatagcatgaatagcagtctcaatacaactggatgaggccctagacttcccgaggaaatggagtcacaaacaccaagccacgtcgactcttgccgaccactggcccagcatccactgaaagtcgggaacacaaaaatgtcacttttcctctttaagctgcctaacggtcactacaagcttacattgagatgctctaagtctgtataccttgtgataattagtaccacactgtagaattaggaaatcaataaccaagtgtttttattgcatatactgtagtcctgtctaaatgccttctagcaggaatatagtaatgtagtgcttattctgtgaatattaccatgtattttttacactgtacagtatagaaaacacaggttaactccgaagtggcaggcatgctccactacaacagacagacaacttttgctgtaagcaatacctagtggtatgagaattctatttcaagtcctaaaatatttcaacttacagcttgtttggaaaaaaatttccatttttgtaaaaatatatgtttcctgattacctcttgctaataaatctattctatctcagggtgaacagcgagttttgatgggtttcattcgttcagtcaaggaatatttgatgagcacttgctccttacccagcccagcctgggaccggagatccagagtgtcaaggacaccatacctgctttttaggcaccaacagtttggtggggaagactgtttcagttgcctattgcaccaagaacaagccactccaaaacataatggcttaaaaccatttttgttacctttcacagttctatgggttgactgggtccagctgtcagttcttatttggagtctctcatgaagtttcagtcactcagcaactgggactggagtcatctgaaggctcaactggaccgggtggtgctctagttggtgcaccaagatggcgctgtcacatggctggatgttgatgtctgctgggctgcactggggctgttcatgggagcatccacacgtggcctctctgtgtggcttgggctcctcacagtccggaagctgggttccaagagcgactgttccagcagcctcaggcagaagctacaaggctgcccagatgcgatcctgcccagatgtgtcctcactgtcacccaggaagggaagccccggaacaccaccctcagtcacaggcatggggcccactgcaaggcacaacccactccagagctcccaaggccgcctcccctgggacctgcagccagctggctccataactgcttttccgtttcctccaggcattttcatcctagccctactttgtgctgggatctgagggggatagcaagcggagaaagaagggatctagagggagaagattctagatccttcttttgactgccagctgattttgattgccagctttacctgcttcatgagctcagccaagtcacttaacctctcagagcttcactgttctcatctgaaaaatggggatgaaaatggtatctcattacagagtagaattaaatgaattattataattaatggtattaa

SEQ ID NO: 426893 - DNA, 552 bp, Homo sapiens
gctacaactgatgagaaagattctgtttcgaacatagccacagaaataaaggatggagaaaaatctgggacagtgtcttctcagaaaccaccagccttgacgtgtcttctcggaaaaaaccagccttgaaggctacaagtgatgagaaggattctttttcgaatataaccagaggaaaaaaggatggagaaatatctaggaaagtgtcttctcagaaaccaccaaccttgaagggtacaagtgacgaggaagattctgttttgggtatagccagagaaaacaaggatggagaaaaatctaggacagtgtcttctgagaaaccaccaggcttgaaggcttcaagtgatgagaaagattctgttttgaatatagccagaggaaaaaagtatggagaaaaaactaagagagtgtcttctcgaaaaaaaccatccttggaggccacaagtgatgagaaggattctttttcgaatataaccagagaaaaaaaggatggagaaatatctaggaaagtgtcttctcagaaaccaccagccttgaagggtacaagtgacg

SEQ ID NO: 426894 - DNA, 595 bp, Homo sapiens
ctcagttattgggcaagttaaagagcatgatgaatgtttgcagtataatggtgtaaatcctcttaatttgttgcatgaaagacatgtgggatcatgtagcacctgttttgacattgattctcacgtatatgagttgctcctctgattttagatcacatttgttctcatcactcggcatatccacattgagattgacacggttttattttagttttcgacacatgacaaatcttaccatgtttgaaatcgtaagggtgtatttcacagagcctgtgttcccttttttcagtgtatttctgtcatgttctgatccccagacacaaagtagaagccatcaaagcctccactaatacaagcaggaggacagaggttgatgctaacactgtgtgaatctatggataattttatcatgtttacatgtgagtgattatgtatcccttttgcttttcagtgtcttctcgaaaaaaaccatccttggaggccacaagtgatgagaaggattctttttcgaatataaccagagaaaaaaaggatggagaaatatctaggaaagtgtcttctcagaaaccaccagccttgaagggtacaagtgacg

SEQ ID NO: 426895 - DNA, 2540 bp, Homo sapiens
acatcaccaggatacctacagacagattcacattgacattccaaggacgaatcctctcattccgttgttccagcaaccacttgtacaggagatctttgaaagaattctatttatttgggccatccgccaccctgccagtgggtatgtccagggaattaatgacctggtcactccattctttgtcgtcttcctctcagaatatgtggaagaggatgtggagaactttgacgtgaccaacttgtctcaagacatgctgcgaagcattgaggctgacagcttttggtgcatgagcaagctgctggatggaatccaggataactacacctttgcacaaccaggaatccagaagaaggtgaaggcactggaagagcttgtcagccggattgatgagcaggtacataatcacttcaggaggtacgaggtagaatacctgcagtttgccttccgctggatgaacaacctgcttatgcgggagcttcctcttcgctgcaccatccgcctgtgggacacatatcagtctgaaccagaagggttctcccactttcatctctacgtgtgtgcagccttcttgatcaagtggaggaaagagatcttggatgaggaggattttcagggtctcctcatgctgctacagaacctacctacaatacactggggcaacgaagaaattgggctgcttctcgccgaggcatacagactcaagtacatgtttgccgatgccccaaatcactaccgccgataggtgctgtctcctccggggacccagactgccttcatctctgatggcagtctgatcactgtggccactgtgcgagccgtggaccccggccaggaaccactcctgttgtacaaagctcacacccaccgcccaggtcttaactttctggcatccaccactccatgtctctggatgtgtcacttggaccactgtcagtattccatgccgcgtggatgggcccagttctgggagaggacagaaaaggtggtacagggttgtctgcccctttaaaagaaactggacaaagaaggggaaggctcagggtctcacctcacattgtccctacaaggacaggccccaactgataaccgttgcttttttttttttgtgaacatagtttgatttgatcacaggtcaaaaacgccttatattttcgaaagactcctggcccctcttccctcttcctggtttcctagccgttccccttctgccccagtctgagccagtgaggggtagctttttaaaaccattattctagatggaggaggcactgatgcttgtaactctggaaagaggcctacacccaagggctaggaattttatttttccttttctcaccaggtgtctgcatgtgtgtgtgggtgtgaatgtgtatacatgcccatcagcatttagtcacatgtctgaatttctgtgtccagacgagccccatcaaactagttgggaagggccccagtgaccaagtgtataagcatcccttgaagagggattggggcaggggaggcagaaggggctctccagaccccttttccatgatgacccactccaagatattatgtgtaaattgtgttattatgtatatgggtaaagatgtacaaatatatgtcctctttgtagcagatatgattttatatttataatgtgcatcaacatgtgaaagcaatctaggtcactagcacagaggaagttgccaggaaggtggcttcagcacctccaggttggttctgggtgtcctgctgtgaggggtagaacgggaggctgctgaagtgagtagctgagcagctggagccatcccaagcatcagtgtctcagagtcctcctcgcccctttcttcaccccgccccccaacccccagactttcctggagcatctgccctttgctcctagcagcctccccaggaagggactgcagaggcgggcaagccctctctatgtgtttttatctccaccttccccggaatctggggagggcttttgtttttacgttttcaagttcagcattgtattcggacagaagctgtgactgaagactcagtgccaaggaaaggggcttcttgtgtgtccctcgggtttggggctcttctcagagagcagcactccatatcccttactgtcaccttcactccccacacagctcatgagatgtgtgacccctgtttgagttttggtatttggtagtggagggtggggggatgggggccagcagctgtcatcctcctgggaagccgagcagtgtccctggtgggtaacaccctcaagtctctttgccagtgaggccccaccacatcggtgtgagttaggtttctcatctggagctgtttctcaggcattcttcccaaccctcttccttttccccttcggtgtgcctcagtggtctccttcatagagtgagagggcttgagaccctccctcaaccggactaattaaagaaagacacttgtgttcccaagtggtggttttatttttttagtttttatgtttgtatgggaaattgtggataaagtgaaaagaattgtaaataaatggtgtatttcctcctcca

SEQ ID NO: 426896 - DNA, 1249 bp, Homo sapiens
acatcaccaggatacctacagacagattcacattgacattccaaggacgaatcctctcattccgttgttccagcaaccacttgtacaggagatctttgaaagaattctatttatttgggccatccgccaccctgccagtgggtatgtccagggaattaatgacctggtcactccattctttgtcgtcttcctctcagaatatgtggaagaggatgtggagaactttgacgtgaccaacttgtctcaagacatgctgcgaagcattgaggctgacagcttttggtgcatgagcaagctgctggatggaatccaggataactacacctttgcacaaccaggaatccagaagaaggtgaaggcactggaagagcttgtcagccggattgatgagcaggtacataatcacttcaggaggtacgaggtagaatacctgcagtttgccttccgctggatgaacaacctgcttatgcgggagcttcctcttcgctgcaccatccgcctgtgggacacatatcagtctgaaccagaagggttctcccactttcatctctacgtgtgtgcagccttcttgatcaagtggaggaaagagatcttggatgaggaggattttcagggtctcctcatgctgctacagaacctacctacaatacactggggcaacgaagaaattgggctgcttctcgccgaggcatacagactcaagtacatgtttgccgatgccccaaatcactaccgccgataggtgctgtctcctccggggacccagactgccttcatctctgatggcagtctgatcactgtggccactgtgcgagccgtggaccccggccaggaaccactcctgttgtacaaagctcacacccaccgcccaggtcttaactttctggcatccaccactccatgtctctggatgtgtcacttggaccactgtcagtattccatgccgggcagagctaaatgggaacccatcaccagagaagccaccaccaaagccaagattacagagagaatgttttaggagtagggtggaatttaacttctaaacgtaaataattaacattttgaaatgaagtgacagtgtcaccttataatgcaaaatcatgccatattatacaagaaactccacaccatgaagaattctgcctatacagttttaattgcccaaagagacaaatttattgaaataaacagctactgaacatctattacatactgcaaattatatgccttggggtgccgagctcgaaag

SEQ ID NO: 426897 - DNA, 245 bp, Homo sapiens
agataagacctctggactttcttcaccttttgttttacagaagaggatgtggagaactttgacgtgaccaacttgtctcaagacatgctgcgaagcattgaggctgacagcttttggtgcatgagcaagctgctggatggaatccaggtgagctgcttctgcccttgtgggaacaaacgtctaggtccagaggctcccagcagggctttggtttctttcttgctcttctgtatcaggcaggacca

SEQ ID NO: 426898 - DNA, 2191 bp, Homo sapiens
acatcaccaggatacctacagacagattcacattgacattccaaggacgaatcctctcattccgttgttccagcaaccacttgtacaggagatctttgaaagaattctatttatttgggccatccgccaccctgccagtgggtatgtccagggaattaatgacctggtcactccattctttgtcgtcttcctctcagaatatgtggaagaggatgtggagaactttgacgtgaccaacttgtctcaagacatgctgcgaagcattgaggctgacagcttttggtgcatgagcaagctgctggatggaatccaggataactacacctttgcacaaccaggaatccagaagaaggtgaaggcactggaagagcttgtcagccggattgatgagcaggtacataatcacttcaggaggtacgaggtagaatacctgcagtttgccttccgctggatgaacaacctgcttatgcgggagcttcctcttcgctgcaccatccgcctgtgggacacatatcagtctgaaccagaagggttctcccactttcatctctacgtgtgtgcagccttcttgatcaagtggaggaaagagatcttggatgaggaggattttcagggtctcctcatgctgctacagaacctacctacaatacactggggcaacgaagaaattgggctgcttctcgccgaggcatacagactcaagtacatgtttgccgatgccccaaatcactaccgccgataggtgctgtctcctccggggacccagactgccttcatctctgatggcagtctgatcactgtggccactgtgcgagccgtggaccccggccaggaaccactcctgttgtacaaagctcacacccaccgcccaggtcttaactttctggcatccaccactccatgtctctggatgtgtcacttggaccactgtcagtattccatgccgcgtggatgggcccagttctgggagaggacagaaaaggtggtacagggttgtctgcccctttaaaagaaactggacaaagaaggggaaggctcagggtctcacctcacattgtccctacaaggacaggccccaactgataaccgttgcttttttttttttgtgaacatagtttgatttgatcacaggtcaaaaacgccttatattttcgaaagactcctggcccctcttccctcttcctggtttcctagccgttccccttctgccccagtctgagccagtgaggggtagctttttaaaaccattattctagatggaggaggcactgatgcttgtaactctggaaagaggcctacacccaagggctaggaattttatttttccttttctcaccaggtgtctgcatgtgtgtgtgggtgtgaatgtgtatacatgcccatcagcatttagtcacatgtctgaatttctgtgtccagacgagccccatcaaactagttgggaagggccccagtgaccaagtgtataagcatccctttcttcaccccgccccccaacccccagactttcctggagcatctgccctttgctcctagcagcctccccaggaagggactgcagaggcgggcaagccctctctatgtgtttttatctccaccttccccggaatctggggagggcttttgtttttacgttttcaagttcagcattgtattcggacagaagctgtgactgaagactcagtgccaaggaaaggggcttcttgtgtgtccctcgggtttggggctcttctcagagagcagcactccatatcccttactgtcaccttcactccccacacagctcatgagatgtgtgacccctgtttgagttttggtatttggtagtggagggtggggggatgggggccagcagctgtcatcctcctgggaagccgagcagtgtccctggtgggtaacaccctcaagtctctttgccagtgaggccccaccacatcggtgtgagttaggtttctcatctggagctgtttctcaggcattcttcccaaccctcttccttttccccttcggtgtgcctcagtggtctccttcatagagtgagagggcttgagaccctccctcaaccggactaattaaagaaagacacttgtgttcccaagtggtggttttatttttttagtttttatgtttgtatgggaaattgtggataaagtgaaaagaattgtaaataaatggtgtatttcctcctcca

SEQ ID NO: 426899 - DNA, 839 bp, Homo sapiens
acatcaccaggatacctacagacagattcacattgacattccaaggacgaatcctctcattccgttgttccagcaaccacttgtacaggagatctttgaaagaattctatttatttgggccatccgccaccctgccagtgggtatgtccagggaattaatgacctggtcactccattctttgtcgtcttcctctcagaatatgtggaagaggatgtggagaactttgacgtgaccaacttgtctcaagacatgctgcgaagcattgaggctgacagcttttggtgcatgagcaagctgctggatggaatccaggataactacacctttgcacaaccaggaatccagaagaaggtgaaggcactggaagagcttgtcagccggattgatgagcaggtacataatcacttcaggaggtacgaggtagaatacctgcagtttgccttccgctggatgaacaacctgcttatgcgggagcttcctcttcgctgcaccatccgcctgtgggacacatatcagtctgaaccagaagggttctcccactttcatctctacgtgtgtgcagccttcttgatcaagtggaggaaagagatcttggatgaggaggattttcagtgtttctcaggcattcttcccaaccctcttccttttccccttcggtgtgcctcagtggtctccttcatagagtgagagggcttgagaccctccctcaaccggactaattaaagaaagacacttgtgttcccaagtggtggttttatttttttagtttttatgtttgtatgggaaattgtggataaagtgaaaagaattgtaaataaatggtgtatttcctcctcca

SEQ ID NO: 426900 - DNA, 1185 bp, Homo sapiens
  misc_feature (1)..(4): n is a, c, g, or t
nnnngtttgctctgagataccagtctcgctcctgcccagcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccat

SEQ ID NO: 426901 - DNA, 1123 bp, Homo sapiens
  misc_feature (1)..(4): n is a, c, g, or t
nnnngtttgctctgagataccagtctcgctcctgcccagcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccat

SEQ ID NO: 426902 - DNA, 775 bp, Homo sapiens
cggatgggtgtattactgctggattcaactatccaaagggctgtcatgtggaggagagattttaatttctctttgtgggcccaaagggcaggaactgaaaccaatgggtggaggttatgttaacacacattttggctcaacatgaagaagaattttctctaacaatcagaatttccaatagtggaaatccctcagttcctggggatgcagtggtgtgtggacccaagaggaccactgtttgataggggtattgaagtagagaatgtagcacctaatggagttgggagtggggctggaagattgctgaggaactttctgttttttttttgttttttttttgttttgcagttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaaggtaagggcccagggcatcaggaagagggtactggagacctgggcaaatctggtctctaaatcccacacacccgtattatccgttccatgactaggggtatgacacaaaccactatacctttccctgtctcttccttggcttcctgtattgttccctcctgcctgtctttctgcagtctgtggctgcatgatcctggaggtatttctcaagctgaatatactgctgatatcctggaagagagtagagggcagggagcaatctgatgatg

SEQ ID NO: 426903 - DNA, 496 bp, Homo sapiens
cagtttctagcaatcaagccttttaccccaaaccaggaacctgacatcagccagtaagcaccccaccccgactccattgccagtttctgaatccttcatgagtgtgcagtcctcctcctcccaaaaaggcagctatgtagggtggaaagaacaggtaagttgtagcagctttggaattcctctctgggtcacctcagacacactacttccttcttctgaaccggtttcctccccagtgaaaaaaaattagttgctccctgacaggattgttataaggatgacatgaaatgtgctgtcctcgtagagctgctcactgagttgaatgagtcgtggaacacttcctcttcatcctctagatgaggtgtctggccagctcattctcaccaacctctccctgacctcctcgggcacctaccgctgtgtggccaccaaccagatgggcagtgcatcctgtgagctgaccctctctgtgaccggtagggatgctgggtggagg

SEQ ID NO: 426904 - DNA, 593 bp, Homo sapiens
gaggaaatcaggaaaggggaggggaaactgcctctgtcatccactttagctgccagtcagggtctaggatagggatcagagcaacatttctccaggtggagtcctcagattacctggacagaaatcaccgggaactagttatacattcagattcaggccacttctagccaaagttccgcagattattctcaagcacagtgaaatttaagagtccccaggttagaggacggccctcctccgcaggaggcttctactgttcactcagaacttgcctatacccatcagggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccataaaaactccttcttctttctgctggtatggcgaattcctctaggcggctcagagtattaacagtaagagaaggaatgggcttgaagtccgagaaaaggtaggcaggaagtttg

SEQ ID NO: 426905 - DNA, 1680 bp, Homo sapiens
  misc_feature (1)..(4): n is a, c, g, or t
nnnngtttgctctgagataccagtctcgctcctgcccagcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtggtgaggaggggccgggcgggaccacggcgagggctggggggcataggcctggcttccccggctcctcggacccactctgtccccgccaggccagatgaggctgccgtgggcgccagggccctaaggcgcctgaggtgaggccggagagggggtgtccaaggcccggagggcgtaggagagagacccccaagccggcgagcgagttgggcctctccgcggcacaggcctgaaccaccccaccgcagggctagtgttttcctttctctgctaaacacacacaccctcttacctggcccggttccggctcttttacccacaaagacccggcccctcccggaaacctcaggttttgggaagggaggggttggattgaggggagagggttgtgctctggggagggagcccccagcttccaatatagatgcccgggggtgggcccgaccctccagatcactggaatttgggttcccacctccctctggtccccggccccagggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccat

SEQ ID NO: 426906 - DNA, 1237 bp, Homo sapiens
  misc_feature (1)..(4): n is a, c, g, or t
nnnngtttgctctgagataccagtctcgctcctgcccagcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagagctgctcactgagttgaatgagtcgtggaacacttcctcttcatcctctagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccat

SEQ ID NO: 426907 - DNA, 967 bp, Homo sapiens
cggatgggtgtattactgctggattcaactatccaaagggctgtcatgtggaggagagattttaatttctctttgtgggcccaaagggcaggaactgaaaccaatgggtggaggttatgttaacacacattttggctcaacatgaagaagaattttctctaacaatcagaatttccaatagtggaaatccctcagttcctggggatgcagtggtgtgtggacccaagaggaccactgtttgataggggtattgaagtagagaatgtagcacctaatggagttgggagtggggctggaagattgctgaggaactttctgttttttttttgttttttttttgttttgcagttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccat

SEQ ID NO: 426908 - DNA, 288 bp, Homo sapiens
ggtacccacagactttaattattgatattccccctcaccgccctcagggatggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccat

SEQ ID NO: 426909 - DNA, 480 bp, Homo sapiens
gaggaaatcaggaaaggggaggggaaactgcctctgtcatccactttagctgccagtcagggtctaggatagggatcagagcaacatttctccaggtggagtcctcagattacctggacagaaatcaccgggaactagttatacattcagattcaggccacttctagccaaagttccgcagattattctcaagcacagtgaaatttaagagtccccaggttagaggacggccctcctccgcaggaggcttctactgttcactcagaacttgcctatacccatcagggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccat

SEQ ID NO: 426910 - DNA, 1281 bp, Homo sapiens
  misc_feature (1)..(4): n is a, c, g, or t
nnnngtttgctctgagataccagtctcgctcctgcccagcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcggtgagcaggagggctggggggtggcgcaaggagggaggaaagggcttgagttaaaagcgggtgcctgcaaccctcaaactccgacatcattcagtgtgtttaggggcaggaggtgttgttcagccgtggaatttgctggtggcagcagtgtaacctgtgtatttgagggtacaggcaagcggtacagggtggagtggctggtccacaagctgtggcagggaagctgtttgcaggactgccctgcccctcctcatatttaataaagtttacttttctgttcaaaaaaaattt
